United States Patent 6,476,212 (POLYNUCLEOTIDES AND POLYPEPTIDES DERIVED FROM CORN EAR) - sequence listing, part 2

SEQ ID NO: 4234 - DNA, 299 bp, Zea mays
  misc_feature: Incyte ID No: 700348021H1
  unsure 2, 16, 18, 38, 83, 107, 110, 116, 176, 183, 234, 249, 251, 255, 287: a, t, c, g, or other
ancgcaactccgcaantncgcaacctcctccttcccancccttctcacgcgattcaagcgtttcccattcggagccctaatcntctctttccatactcgcggaagcnaancaccancggcaggggaagcggaaggggagcacctcgggccaggcaagatggtgcttgcgcagtggncgggagnatctcccgcgccctggcgcagatgagcaacgccacggtgatcgatgagaangtgctcaacgactgntnaacnagatctcgcgcgctctcctacagccgatgtcnattcaagatggt

SEQ ID NO: 4235 - DNA, 290 bp, Zea mays
  misc_feature: Incyte ID No: 700348022H1
  unsure 53: a, t, c, g, or other
cgcttcctcccgttagactaggttaggctagggtgtcgaccagctcgcggacntggtggccttcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaatacggcatctg

SEQ ID NO: 4236 - DNA, 294 bp, Zea mays
  misc_feature: Incyte ID No: 700348026H1
gaaatagcggacaaggatgggtttgaaacatgtgaacaagtagcttgttgcacacacatgtttcaggattcaagtggtttagttcaaagagacgtagccttgctgcgaagttctcaaaacaaattgtatctgctactacttgatatggtttttgatggacaagaaaccatgccaagaattttgggcagctatagtctgcaaagtctagaaaaagtttcaattgggctgggactacaggcgctgagagtacacatgtcagatgatacaactcatctattcatcacaggattccag

SEQ ID NO: 4237 - DNA, 298 bp, Zea mays
  misc_feature: Incyte ID No: 700348029H1
  unsure 45, 138, 163, 296: a, t, c, g, or other
cttcgtcgatctcaccaccgcgccgaccccgatggcctccgccgnctcatcggccgccgccgctggcaaatcgctgttccaggggttccgcaggttcctcaaaaagccgtgggagatcacgggcccctgcgcctcgcncgagtaccgcagcgcgctgcctggngcgctcgagtaccgcgtcaagtgcccggccaccgtgcgcgacgaccgcgacaaggccatcgtgcccacatccgatccggagacagtctacgacatcaagtattcagccgcgatcgccgccggaaccgtccgcncg

SEQ ID NO: 4238 - DNA, 297 bp, Zea mays
  misc_feature: Incyte ID No: 700348031H1
  unsure 200, 204, 206, 255-256, 284: a, t, c, g, or other
atctaagacaaaagtcactactcttccaaatggcgtcaagatcgcctcggagacatcatcgagcccagcagcaactgtgggtctgtacattgactgtggttccatttacgaaacacccgcttcatctggagtatcacatctgttggagagaatggccttcaagagcacagtgaatgggactcacttacggttagttcgtnaggnanaagccattggaggaaatgtctctgcatcagttcccgtgaacaaatgagnnatacctatgatgcattgaagagctatanaccagaaatggtg

SEQ ID NO: 4239 - DNA, 296 bp, Zea mays
  misc_feature: Incyte ID No: 700348032H1
  unsure 250: a, t, c, g, or other
tcatatgtatcgaatgtaaactggatgatgaaccgtgcattatttacaagccattgctatctgtcatgggggtttgtctggccatacattatggctttggtccatgttttagctgctcttcgggcaccgtacagcaaagttgtaaaggaagcatccgattcatcttggggtttgttcctggtgggcctcttgttcacatgcactctgatcgagctcgttcaatgtggaatttgactaaggtggaaattcnactgtgcaatatgctgctcctgaaggaccgaaagtactcttgattc

SEQ ID NO: 4240 - DNA, 302 bp, Zea mays
  misc_feature: Incyte ID No: 700348033H1
  unsure 2, 4, 227, 259, 271, 287, 292: a, t, c, g, or other
ananggttccccttcatgcattgttggactaaactcaagaacgaacccaaatggcaagctattgttcaaggcacttcactacgaggggcagcagggatgtcaccggttggcagtgccacaccaactgcaagtgtaaacgatttggatagcgattctctaggtttaactgggaaaaggccattaggccgagactccacaaaggcatcaaggaagaaggccatgtccangtcgtcccagtccatgaagtatttgaccaganttcatgacctgnaaatggccggttgaancaagntgaagacaag

SEQ ID NO: 4241 - DNA, 123 bp, Zea mays
  misc_feature: Incyte ID No: 700348035H1
  unsure 41, 55, 90: a, t, c, g, or other
cgagtcgaaccctatgccccacgttaagcctgccgccggcntgcccccttaccancaccgggcgctccctggccccgggcagggtccagntcccacgggacatgggatgatgcaccgggaggt

SEQ ID NO: 4242 - DNA, 132 bp, Zea mays
  misc_feature: Incyte ID No: 700348036H1
  unsure 8, 61-62: a, t, c, g, or other
cagctaanaagttaggtcatgcctctactctaactctcctaagtacagtgagatgtatctnngaattgcaggggctggagggactgtgctatatatgaggacatcacttagtactttagaatttatgggtca

SEQ ID NO: 4243 - DNA, 281 bp, Zea mays
  misc_feature: Incyte ID No: 700348041H1
  unsure 26, 53, 64-65, 87, 120, 124, 132, 148, 150-151, 155, 181, 183: a, t, c, g, or other
cgagcagcagtaggcagcggcgcggngcgaggagcagaccagcacccagcagncctcgtcgggnngcggcagtcgcagcttcaccanccgccgcctttccccgtctcctctgcctctgcntctncccctaanccccttccatttctcnannccancccgctcccgcttccgcttcctcgcnanttagttcgttccgcagccgcagccgcgatggttcgattgggggcagcaatggagcataagagaagtggagaagatggggagggcagtacgggtgtgta

SEQ ID NO: 4244 - DNA, 289 bp, Zea mays
  misc_feature: Incyte ID No: 700348042H1
  unsure 74, 244, 270, 277: a, t, c, g, or other
cggcgacgcttccgcctaaccacttttatggttaccagggacagagtcagctgggtggctttggtcaggcgcanagcaacagccttcccaattcggaggccacgggtacccgactttctaccagtctcagggtgggctgacacaggagcaccacccccagaaccttgctgagggcagcctgaatggcttccaggtcgcaccgtctcagccgtctcatccgagctggcagcatcagcacacctantgagcattgttctcccttgttatggnctgtctntttcgccgtcaa

SEQ ID NO: 4245 - DNA, 286 bp, Zea mays
  misc_feature: Incyte ID No: 700348043H1
  unsure 282: a, t, c, g, or other
tgttttgagaaaataaacagaaaattgtcccaactcgtagtgtcatcctctcgatgagagtaagagtctcgttgcttacacatatgagggtttttatctgtcttaagagaagtacattctggatcttcttgatcgggcctctcttactgatagcggacagttgaggctcctatggaactcaatattcatctatgtgccacggatggtgagcctcttgaagaccctaatcattattgtcacattgttgggcctcttgtttacgttggtgtgactcgtcctgantctt

SEQ ID NO: 4246 - DNA, 414 bp, Zea mays
  misc_feature: Incyte ID No: 700348056H1
  unsure 53, 58, 74, 88, 95, 108, 114, 145, 154, 172, 178, 181, 183, 186, 216, 229,: a, t, c, g, or other
tcaacgtagtacagtccacacatgacacaacgacaccaactgtcctccaatcnagccngcctcgagtctcgtcnccgcacatcagcanagagacngcactaccaccancgcaancgacgacggggagatgtttctgcgactgatnctgatcggngaggtggcttggcggcgntatgtnggngncgnggtgaaggagacgacgtgatcgtcggcctnaagtggcgctaangngcggaggtcctcatcgggctctagagcgtacnctcangnanatgatnccgtccnaagagaggntacngcaagccgttagnnttagaatnangntnnantntnnngagngagatgnnaggcatgtggacgatggatnngnaagtgngagtttgagagccntganagtgagtattcnaatgtgat

SEQ ID NO: 4247 - DNA, 429 bp, Zea mays
  misc_feature: Incyte ID No: 700348062H1
  unsure 13, 165, 195, 211, 218, 392, 413: a, t, c, g, or other
ccctggactgganctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcngcgtaataatgcgtgaagcttgcagacttngttaagccagggcatntggaatncctgtccgtacatttactcatgaggtagtgacatatggtacagagctccagaaatccttcttggagcgagacagattccacaccagttgacgatgtctgtgggctgtactttgcggaatgtgaacaaaaagcatatcctgtgatctgagtcgcgactgtcaagatatcagggtntaggacacgaatgacaagttngctgagcagtgttgct

SEQ ID NO: 4248 - DNA, 431 bp, Zea mays
  misc_feature: Incyte ID No: 700348064H1
  unsure 3, 7, 16, 36, 95, 117, 123, 163, 177, 191, 199, 206, 239, 289, 310, 416,: a, t, c, g, or other
canctcnccgtccggncgtccacccacgcttcctcnccctccgcgccgctcctacaggctctaaccatggcggtcgccaccgagtcgcgcggcangaggacagggttcagccatgcnaaccangagaagcggtgggtgctgtctgatttcgaggttgggaaanctcttgggaagggnagtttggccatgtnatcttgcnagagaanaaaggagtagtgagatgtggtttgaaagttctntccagagccagtcaagcaatcacagttgagcatcactgcgacgtgaagtngaattcagagtcacttcgcancctaatatctccgctgatgggactctatgatcagacagggttactaatcctggaatagctgcaagggtgaactgtataaagactgacaagtgtaacattttcagangnncacangnctatt

SEQ ID NO: 4249 - DNA, 176 bp, Zea mays
  misc_feature: Incyte ID No: 700348065H1
  unsure 42, 62, 67, 79, 96, 101, 168-169, 175: a, t, c, g, or other
agaacttgtggcttgcttggttgtgagatgcgtacattccanaggagcagcctgggggaggnggcangctcagccagcncttggagctcagagcantggcncaggctccagctcgcctccagtggaagcccgagcgccctcagaaacgaccctggccaatgtcaacgnnaaccgng

SEQ ID NO: 4250 - DNA, 423 bp, Zea mays
  misc_feature: Incyte ID No: 700348070H1
  unsure 47, 98, 127, 171, 189, 247, 316, 363, 373, 392, 399, 412, 415, 417, 419: a, t, c, g, or other
ggacgcacaccagcacggcagcactgcctcctcgccgtcgtgcctcnctccgcgcgaccgatctaccctccgccgccaccatgtcgctgatcgccggngaggacttccagcatatcctgcgtttgtngaacaccaacgtggatgggaagcagaagatcatgtcgcatgacntcatcaaggtgtcggcgngttctccaacatcgtctgcaagaaggccgacatcgacatgaacaagagggccggcgantgacgcctgatgactggagcgcctgatgacgtcgtggccaccctaggcattcaggtgcggatggttccncacaggaagaaggatacaagacgcagtctcgcagtcgctccacgccntgatatgaantcaggacgacttgagagcncagaganaggaacacgttgnttngnantatg

SEQ ID NO: 4251 - DNA, 422 bp, Zea mays
  misc_feature: Incyte ID No: 700348072H1
  unsure 75, 102, 165-166, 180, 199, 205, 294, 312, 314, 334, 354, 369, 372, 378,: a, t, c, g, or other
cggatcaccgactcgtggcaggtccccctccagagcgaggatgtcaagctcgtcaccgcatgagacatgccagtnagccagcagtttcgccggttctttctntatgaagtggatgcaattagaaaggcgtgtgccagttggaagagggctaccttcctccagtanntcattgtggtgcanaagcgccatcacacacgtnttgtcntaaagatcatcattcacacgaacagacagatcgacgtggaatatttgccagaatgcagcatgatgggtctaacaatgagttgatgcagnaagtgcaggtagagtgananatggtattgagacaaaatantgaactagagagaagtgatnagactgtgacgctcnacnaagttnantagancacagnnacnttccagtanccanannnttgggtcngt

SEQ ID NO: 4252 - DNA, 422 bp, Zea mays
  misc_feature: Incyte ID No: 700348076H1
  unsure 10, 41-42, 160, 227, 317, 345, 352, 354, 360, 370-371, 393-394, 399, 402,: a, t, c, g, or other
ccagagacangcgtcttcgtactcgctatctccgcgactcnnagctttcccaattcccccccttctcccatttctcaccaccgccgccgtccccccgttcaacaacaccatgagggagtgcatctcgatccacatcggccaggctggtatcaggtcgganacgcgtgctggagctgactgcctcgagatggcattcaggctgatggccagatgcccgtgacaagacnattgggggaggtgatgatgctttcaacaccttcttcagtgagactggcgctgggaacacgtcccccgtgtgtttttgttgaccttgagcncattgtcatcgatgaggtgaggatgcanctaccgnantcttcnatctgagaanncatcagtggcaagaggatgagnnacaantcntcgtgnatacacattggnag

SEQ ID NO: 4253 - DNA, 421 bp, Zea mays
  misc_feature: Incyte ID No: 700348078H1
  unsure 14, 266, 310, 315, 317, 410, 414: a, t, c, g, or other
ctcaaccaattcanagtcacagcggcgaaactctcggcgatgtctggccgcggcaagggcgggaagggtctgggcaagggcggcgcaagcgcaccgcaagtgctgcgtgacaacatccagggcatcaccaagccggcgatccgcagttggcgaagaagggccgcgtcaagcgcatctccggggttcatctacgaggagacccgcggcgtgctcaagatttcctcgagaacgtcatccgcgacgccgtcacctacaccgagcacgcncgccgcaagactgtgaccgccatgaagttgtctacgctctcaangccangnccgcacctctacgtttcggcggtaagtcgccctctccggtggcgaattacttgtgcgtgcgtcgtgtgtgtcttgttagtagctggtgcttancgtntgtttct

SEQ ID NO: 4254 - DNA, 408 bp, Zea mays
  misc_feature: Incyte ID No: 700348079H1
  unsure 8, 358, 378, 380, 399: a, t, c, g, or other
aattgaangctgcccaaccttgcgccggtaggtggtggcggtgaggatagagggttacctgaggaggcagtgatggcggccacgattcagtacaaccggagcaacccggcggtgaagcggatcctgcaggaggtcaaggagatgcagtccaacccctcacccgacttcatgtccctccccctcgaagaagacatcttcgagtggaatttgtatcctggtccgagagacagcgagtttgaggtggattatcatggcaggatccagtaccttcggattaccatcaagccacgtcttcatgcacttacgccaatgacgcttgagatcagaagagattcttgagcataccataccacctganactgcacttatgatgccgananttggaacctaatcttcatncgcgaccag

SEQ ID NO: 4255 - DNA, 432 bp, Zea mays
  misc_feature: Incyte ID No: 700348083H1
  unsure 11-12, 15, 17, 21, 139, 172, 238, 305, 330, 337, 409, 412, 421: a, t, c, g, or other
aacgtatgcgnnctncncgcngaccatctctttctgagcttgagaacagatggtccgcgtgcagaaggtcataaagagatgcaaactggctgcagtttcgccgaggtcgaaccgtgtactgaggccacagggcaagccncatcgtgagggacaccgggacacgataatgganctgagagcatggcaagtccgtgcagtggaagtgcggatgacctacaccaagggcagcgagggcctntctgcgtcgagaagtcgatgtggcggcccaaagaactcgacgctagcacgtgaactgtgttgaggangaactgctacccacgtaggggtganataagangaatttgcctctagatatgcgtatgcccttgttggtctgaaagaccagaaatattggtgtactgtagacaancantgttttctncgttgttcgtt

SEQ ID NO: 4256 - DNA, 393 bp, Zea mays
  misc_feature: Incyte ID No: 700348090H1
  unsure 103, 144, 166, 185, 239, 275, 333, 344, 362, 377, 387: a, t, c, g, or other
cagcaagctggaaatggtgcgtcccttacattccagagagtgaacgctctggtgttataagtgtcgcagctacagaagccaagaacaacaggaaacatctgcncatactcttagattgaggctatgagatgcctaaaccttcgntgcccatagcaacttcacaaancagcatgtccacaccactnctgatctggtccagtccagaggcagctactacaaggaagcaatcaacatcatgntcaaccaccaagtgatgcatttctgtgagttggtgncaacttcgccttgatgtgtcaaagaatgggaaggcacatatctcttctacacctcaantcgtcttaagnaaccacaccatgggctcncatctgtggggaggnagtcgaacanggatca

SEQ ID NO: 4257 - DNA, 423 bp, Zea mays
  misc_feature: Incyte ID No: 700348091H1
  unsure 40, 121-122, 125, 134, 335, 370, 374, 389, 418: a, t, c, g, or other
ttacaacgagatggtccgcttaattgagacagcaactgcncctgtcttggctgttgacattgccggtaacataaatggatggaacaaaaaagtgcagaactaacagggttacctgtaatgnnagncatagggangcctctgatagatcttgttgttgctgattctgttgaagtggtaagcagatttggactcagctttacaaggaattgaagagcaaaatctggaaatcaagcttaaaacattccatgaacaggagtgttgtggtccagttacttgatgattactcctgctgtagtcgggacttcagagaaagccattggagttgctttgtagcnaagattgaccaggcagaaagatgattatggataantatntaggatacaaggagntatgttgccataataaagaccccagtgantcacc

SEQ ID NO: 4258 - DNA, 418 bp, Zea mays
  misc_feature: Incyte ID No: 700348092H1
  unsure 5, 160, 372, 412: a, t, c, g, or other
aacanagctggagatgatattagagaagaagactgatgaagagcacaaactttgtagcagagtagaagatcttgaattgcaattgaacaaagagaaagaagattgccaaaggatgtcctccaaaaccaaaaagtaatcaaagcacatgggcgtatataanagcacaggaggattaaagaggctcaggctcgctttgagaggctagcagatttgcttgcttcagatattttgaagccttgtaccaaggagcagggttccatagggattactgccatgaagatccatataatgctaatgaatgagcccaagtgaccaagccaaaccatgttcagcatcgagaaaaagcttattccctcccacaagtgaagagcnaaactggaagagcccgagaggatggtgtgtatgtccacancgagac

SEQ ID NO: 4259 - DNA, 416 bp, Zea mays
  misc_feature: Incyte ID No: 700348093H1
  unsure 6, 37, 61, 109, 111, 113-115, 123, 125-126, 133, 135-136, 146, 328, 346,: a, t, c, g, or other
gatttnacacgcgtccatcacacaaatctggtgcgcntaattggttattgtgttgagagtngcttatttcttgtttatgaattattgagaacggaaacctaagccagantntnnnctctactngnnccatgananncgttcataanccgtcccatgcagatgtggctaggtatgaacctctctcatggaccagtagagtgcaaattgcccttgattcagcaaggggctagagtatatacatgagcacactgttccagtgtatgtgcatcgagatatcaagctgcaatatcctgatagacagagacttacgaccaaaggttcagatttnggctgccaaacttccagnattgaactacatcacagcatccntcntacgagtgttgtacattggtacatgctccagaanatntcgtatg

SEQ ID NO: 4260 - DNA, 412 bp, Zea mays
  misc_feature: Incyte ID No: 700348094H1
  unsure 24, 68-70, 179, 291, 297, 330-331, 334, 343, 345, 355, 366, 368, 374, 376,: a, t, c, g, or other
cctgtatatcatctccgtgaaggngatcaagggacggctgaacagacttcccgctgctggtgtgggtnnnttggtgatggccacagtcaagaaaggcaaaccagagctcagagaaaaggtacatccagcagtggtcattcgacaacgaaagtcataccgtagaaaagattgcgtgttcnttatttgaagatatgcaggagcatagtgacaataaaggcgagatgaaaggtctgccattacaggaccagtagcaaggagtgtgcagacttgtggccccggattgcatccatntggcancttgcatgatctccagtatatttgtaaaaatannaanaactaaccncnaaaaaaaaanaagggggcccntntggtantngtnnncnggggataatcggnccgtacttgtggnnac

SEQ ID NO: 4261 - DNA, 386 bp, Zea mays
  misc_feature: Incyte ID No: 700348095H1
  unsure 2, 85, 127, 258, 284, 321, 323, 332, 356, 358-359, 366, 375, 385: a, t, c, g, or other
antcgcttcttcttcgaggccgtgcggcgcgagtactaccaccccatccgggtcaacttcttcttcgcgccgtggatcgcctgcntcttcctcgccatcgggtgccgccgtccgtggccactgagcncctgccgcagtggctctggtacgcgtcatggcgcccgtgctcttcatgagctcaagattacggccattggatgtccggcggccaaagcgctgtccaagtggccacccgtccaacacctgtcgtgtggcaantctggcggtgctggcgccacatgggntcaggaggcccgtctctctcttcgtgggctgcgatananggtgttctnagtgtacagcgctcccacacgaangnnctaagantcaccgttnttctttgtgng

SEQ ID NO: 4262 - DNA, 238 bp, Zea mays
  misc_feature: Incyte ID No: 700348104H1
  unsure 139, 210, 228, 231, 236-237: a, t, c, g, or other
cttcgggacgcacgtttaccccaagaacaagtacctcacgctgcagatgaccaggtcggccaagggcgtcgtctgtgaggacgtctttgagagcctgattgtgttttctgaagcctggtgggtgggaacaaaagaaganaatccggaagagctcaaacttgagtttccaaaagaattccaaaatgatggcacgacagcagactgtgattncagatggtgtagttgtgnttnctgannt

SEQ ID NO: 4263 - DNA, 189 bp, Zea mays
  misc_feature: Incyte ID No: 700348105H1
  unsure 28, 164, 188: a, t, c, g, or other
aaaactttatcagacttggatgccatanatgttcgaacccatggatttagtagggatggaattcctgaagctggtgacacagttcggatagatgtgtttggaggctttgtattgcaacggattacaaaagaaagaagctttttcagggcaatagctaatatggntatcaagctagattttgttccacna

SEQ ID NO: 4264 - DNA, 193 bp, Zea mays
  misc_feature: Incyte ID No: 700348107H1
gagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagct

SEQ ID NO: 4265 - DNA, 269 bp, Zea mays
  misc_feature: Incyte ID No: 700348108H1
  unsure 11-12, 104, 112, 244, 248: a, t, c, g, or other
ccaccctcctnnctcctcctcccacggtcccgccatttcgtcccccgctcaccaactcaaaccccctccgctctcaaaccctaaccctagccctagcccgctcncggcggancgacaatgccgaaggaggcggcggggcggcggacgaagaggagttccgcgccgaggtggaggagcgcctcatcaacgaggagtacaagatctggaagaagaacacacccttcctctacgacctcgtcatcanccangcgtcgaatggcctcccttac

SEQ ID NO: 4266 - DNA, 260 bp, Zea mays
  misc_feature: Incyte ID No: 700348113H1
  unsure 102, 157: a, t, c, g, or other
tatgttttgaattttatgacaattccagtcatcattgcatgtcattcagagtatccttatacttgaattccgattttctgtttcaattccacaaacttcttnattacgtcttaagctaatgaagtaacttatgaagttttacagcttaatatataanttaaagccattaattttctgagcatttataaacagggatgatgatgaaggcaataagatagggaacatgaaaccattggggaggcatacagttttcttcgtta

SEQ ID NO: 4267 - DNA, 268 bp, Zea mays
  misc_feature: Incyte ID No: 700348116H1
  unsure 212: a, t, c, g, or other
atgcgctgagtttgaaggtggcgagggatctttgctgcggggttctatttgttctcagtgatttttggcaaacactctttggttagattaagaatcatggaaaggtacaaattgatacggaagataggtgatggaacctgtgggaatgtttttatggcttctaatgtagaaactaatgaaattgtgctgttaaaaaaatgaagagaaaattntgtcattgggaagaatgtattagctgcgagaagtgaaggcctccagaaactattca

SEQ ID NO: 4268 - DNA, 264 bp, Zea mays
  misc_feature: Incyte ID No: 700348117H1
  unsure 18, 23, 34, 41, 43, 50, 52, 74, 181, 183, 237, 240, 247, 261: a, t, c, g, or other
ccgcagtctctgaagaanctgancctccggtcgntcaagcngnccctggncnctcttcgccccggcgcacgccntgcctgcttcacgcccgacgccgagagcaagcggattcgtactgggtgcaaggtgagtgcggagtacggtgcggtgaaggacctcacgccggagcaggggcgcggtncngcagggcaagggtcctgcgccgccatcttcaacagctttggcattgccaggaanacnagatacnaaagatgtcacggngaa

SEQ ID NO: 4269 - DNA, 257 bp, Zea mays
  misc_feature: Incyte ID No: 700348118H1
  unsure 42, 62, 81: a, t, c, g, or other
tcatgtgcttccatcatttgagttttctacagtttcacctcnatcaattatcacggaaggtnctagtggagggccatgganaaagagaattaccgatttggatggaactgagggtgatcttccatggtggtgtgtggactgcattactctcaatcgatatcccaaggagaatacaaagtaaatgctcactacaattccctattttatcctcagagatgatatttttccttgatatatgatatatcttatattgtctg

SEQ ID NO: 4270 - DNA, 209 bp, Zea mays
  misc_feature: Incyte ID No: 700348119H1
  unsure 76: a, t, c, g, or other
ccaatccactgagggttcggtttcattatggccatcctgatgtcttcgatcgtcttttccacgttacgaggggcgntgtcagtaaagcatccaaaattatcaatcttagtgaggacatctttgcaggattcaattccacattgcgcgaagacaatgttactcaccatgaatacatgcaagttggcaaatgaagggatgtaggtctcaat

SEQ ID NO: 4271 - DNA, 139 bp, Zea mays
  misc_feature: Incyte ID No: 700348121H1
  unsure 33, 46, 48, 56, 64, 70, 76, 82, 91, 100, 113, 116: a, t, c, g, or other
agagagcttcctcagtccatggaggtgtcgtcnaggctccaaagcntnctcagacncttcctantctgcngctccngcgccncaggatgancctccaaancctagctctttgntcnccgccgcctcctccgcgcatccc

SEQ ID NO: 4272 - DNA, 269 bp, Zea mays
  misc_feature: Incyte ID No: 700348125H1
  unsure 2, 211, 245, 251: a, t, c, g, or other
gngtcgacgactgggctaccggcgcctccaccctccgcctggtgtccttcgccgtcgacgagcgcacaccagggtacagtacgtattgctcgtgatttgtgtaactacggagcaagctgcatacagcacaagatagaagatgggtatccttgagaggatcaaggagattgaggccgagatggctcggactcagaaaaataaagcaacagantatcatcttggacaactgaaggcaaaactagcanagttgnggacacaactattagagc

SEQ ID NO: 4273 - DNA, 218 bp, Zea mays
  misc_feature: Incyte ID No: 700348129H1
  unsure 197, 217: a, t, c, g, or other
gaacaaatcagatttgttcacaataaacttagcaagcttggcataaaggtaattgtcattcacaatctgatttggcggaaaaagatatcccagctttggctgatatagttggtgatgaggacaaggctaaagaaattgttgaagcagcaaaggcttcaatgggccaggatctgtcaccagttgatttgatcaatgtnccagaaattggcccaaaggnt

SEQ ID NO: 4274 - DNA, 158 bp, Zea mays
  misc_feature: Incyte ID No: 700348130H1
  unsure 12, 26, 32, 41, 46, 67-68, 84, 107, 145, 152, 155: a, t, c, g, or other
gcaggatcagcnagctcgtggcaggntccccntccagagcnaggangtcaagctcgtcaccgcatgnncacatgccagttcagnagcagtttcgccggttctttctntatgaagtggatgcaattagaaaggcgtgtgccagctnggacganggntac

SEQ ID NO: 4275 - DNA, 297 bp, Zea mays
  misc_feature: Incyte ID No: 700348132H1
  unsure 42, 263, 283, 289, 291: a, t, c, g, or other
cttttgatggtttcttgctggtgcttcttgctggtgggcctntgcgtactttcacccgtcaagactctcagataatagaagatgacttcagggccctcagagatctgtacttagcagatggggatggtttgccagaggaattagttgacaaggcatcctcccaggtcaagaatgtcctgcccctctttcgagcagactctgaaagtctcattgagcgattcaaacgcatgatggttgaatcgaatcggcctgcgtccaagaanaggttaccattgcctccaanaagagntntgggcc

SEQ ID NO: 4276 - DNA, 178 bp, Zea mays
  misc_feature: Incyte ID No: 700348133H1
  unsure 59, 168: a, t, c, g, or other
agcttggctagccaccaggaaaacggtggttgcgcttgagtttgtgcctgatattgaangctggatatggttggttggttggttggtcgggcatgcaaactccacaagcaccagtgtcggtcgtcgtcgtcgtgacagtatctgtacattgttgaatcgatatgttanccatagcgat

SEQ ID NO: 4277 - DNA, 136 bp, Zea mays
  misc_feature: Incyte ID No: 700348134H1
  unsure 5, 7, 15, 19, 26, 35, 45, 71, 78, 81, 84, 89, 98, 100-101, 109: a, t, c, g, or other
cccantncttctgcncaanaagactncggataagncgtccagggncgggagcaagtagtgcaaagtgcgcncaagaangcngcnaagtnccctaaggnanngcatagantgtactgtcccgagtgatctgatggtt

SEQ ID NO: 4278 - DNA, 218 bp, Zea mays
  misc_feature: Incyte ID No: 700348135H1
  unsure 51-52, 193, 202, 209-210: a, t, c, g, or other
atgcacctttttctcttctaaatgatttatttcagtggcatgcttatgaannatgcagcagcagcaacaacaacgaagccttttcccaagcaagttgggtaggctagagttgaaacccaacagaagccacaaattcatgcttacgaattatggatgcactttttttctagtcattaaatagtttaatgaagangatctctangtatttnngcaggtct

SEQ ID NO: 4279 - DNA, 306 bp, Zea mays
  misc_feature: Incyte ID No: 700348137H1
ttgcacagactcggagcaagataggcctagctggttacaagccaagaacaagtagagcggtagagggaaaatatatctggagagggaaacaatggcgggcgaggacggtcttaaggtcctcggcctgcaggtgagcccgttcgtgctccgcgtgtgcttggcgctgaacatgaaaggagtgagttacgagtacgtcaaggaggacatatccaacaagagtgagctcctgctcaagtccaacccggtgcacagaaggtgcccgttcttattccacaacggtaagcccatctgcgagtcactcgtcat

SEQ ID NO: 4280 - DNA, 316 bp, Zea mays
  misc_feature: Incyte ID No: 700348141H1
tttcggattgtggccatgtaattcatctcagatcggtcggaagaagaacagttcaatctcggttcatcagaagaccatcaagcctatgaagaggctgatcactacgctaagaggaaagcagccaatatttgtgcttccactggtgctagaactgtcaagagaaaactagaagcaagtaggattccacccaatgatttggttagaagaacaggcaaagaacagaaagtacccgcttatgaagttcgtcagttaaccaagaatgagttgctctgaagtgtctgctaggaatgccatcattagggatcatttccatagg

SEQ ID NO: 4281 - DNA, 265 bp, Zea mays
  misc_feature: Incyte ID No: 700348142H1
  unsure 8, 15, 18, 126, 167, 198, 201, 210, 213, 226, 231, 241, 250: a, t, c, g, or other
agcaaaangcacgancancaccgccggccgggaagcaagctcaaaccctaatcgccgtccgccggcgacgccagcacgatggcccgctacgaccgcgccatcaccgttttctcccccgacggccanctcttccaggtggagtacgctctcgaggccgtccgcaaggncaacgccgccgtgggcgtccgcagcacgganacngtcgtcctnggngtcgagaagaagntcganacccaagctncaggactcnagtccgtgcgcaaat

SEQ ID NO: 4282 - DNA, 157 bp, Zea mays
  misc_feature: Incyte ID No: 700348148H1
  unsure 39, 65, 71, 78, 100, 115, 118: a, t, c, g, or other
aagggacttgtcgacgagttccgcgttcctgagaggganaacacaaaggcactagagtttgttcnatcatngcggttngccaatgggatgttcgcaattntcttgtcgtttggcnttntactcactgccctcaggagcaggaaggcacgatcatggc

SEQ ID NO: 4283 - DNA, 115 bp, Zea mays
  misc_feature: Incyte ID No: 700348150H1
  unsure 30, 32, 55, 79-80, 89, 99, 103, 107: a, t, c, g, or other
gcaggaagaccgaagaccgagccgtgcggngncttcggtcactggaacgggacangacctcaaaatctacagatccttnntgcccgctncgcccgttcncgtncgangcgttcgt

SEQ ID NO: 4284 - DNA, 307 bp, Zea mays
  misc_feature: Incyte ID No: 700348151H1
  unsure 48, 66, 77, 80, 89, 107, 150, 158-159, 161, 184, 188, 191, 205, 219-220,: a, t, c, g, or other
ctcctgtcttgtctcccttttctattgttcattcacccccgtgcgctntctccctgccgtggcgangactgggcganagngccgccgcngcagtcgcaaccgtacancaggcgccacggccttcttcgggaccttcgccggcggagtatnttctgtgnnantgaaatgtctgcctctgaaaacnaggntgntggagcagaatganggagtgcgatgaanntnggcccactggggacaaaatcggatnggtntgcgattatcactgagnaggctgttggcngaggttncnantcnatgagcacagntt

SEQ ID NO: 4285 - DNA, 307 bp, Zea mays
  misc_feature: Incyte ID No: 700348152H1
  unsure 295: a, t, c, g, or other
tgtaacggtattggatcgtgctcccacaaaggttatctttagtcttcgaccctaacgacggagaaaggacgcaagagtcacagcgtattcagatgcaatagcgaggctgggagcagatggttagcgaacaccgtattcatcagcatgagcaacatagatacgcacaaactctggagatacgcgaaaattaagactctgaatgtctgggctgacctggggcttgcgagtagatagcttgatgtttgcaaagaagctctgagtgtgggagatagcccgacttgggtgttgtaatcgnctaaattcggta

SEQ ID NO: 4286 - DNA, 299 bp, Zea mays
  misc_feature: Incyte ID No: 700348154H1
  unsure 6, 19, 61, 64, 74, 100, 102, 104, 112, 148, 161, 184, 192, 207, 209, 218,: a, t, c, g, or other
actgancgtgctctggagnacgccaaagcatgccgtgcattgagaccagatttggcgaaanccnggctacaggnaaggtgcggcgcatcgtctgttacanangntgaggaanccgcaaacgccttctatgatggggtgcagcttgagnctgagaacacggngcgcgtcaacgcattcagggagncatcgaanccgggaggaagttcnanggcgtcaanacncnatactcaacacaatgagacttttctgnnggttgntagtantgntnaagtgntggacatgaangttgnnnagttgga

SEQ ID NO: 4287 - DNA, 304 bp, Zea mays
  misc_feature: Incyte ID No: 700348155H1
  unsure 276: a, t, c, g, or other
ttcaggaaaaagaacaactgcatgtatgatcgagtttttcaccaggcctttatgctttggacagcttgccctgcatgctatttctcatctgcttgagagatacatttaaacaagacaagagaaaatttaaagatccaagaagattgtatgcacctgggcgaatgtatcatatcgttgagaggaaattttgcaggtaatgtatcatgtcattgcaaatagtatcttcccctgcttgcgaattgctctttcttttttatgtcataaataatataaacnaaaacctactcttctagtatatgggagt

SEQ ID NO: 4288 - DNA, 301 bp, Zea mays
  misc_feature: Incyte ID No: 700348157H1
  unsure 11, 15, 19, 42, 101, 119, 127, 139, 216, 226, 260, 283, 292, 297: a, t, c, g, or other
gaaaaaaaggnctgncagnccaccagctcagcccatatggcnatccatcccatataggggtggtaatggatcacgatccaaatgtttcttcacaatttgtnagggccctaaattatttntagttcanaaatgaataganatagagcccgatcctaatccgatccgatccttacattttgtagtgtagaatttagagcccattgtcacccctaatcncgtacctgtnttgacctactttgagctccctccagcgccgctcncctacccttagagctccctccanagtcgttgnaccgngatc

SEQ ID NO: 4289 - DNA, 302 bp, Zea mays
  misc_feature: Incyte ID No: 700348162H1
  unsure 46, 109, 118, 121, 130, 147, 168, 179, 183, 190, 193, 199, 237, 239, 245,: a, t, c, g, or other
ctttgaaagtgctaaggatatacccatgttcatttctgctaaaaantagcttcatatgcatcattgaaacttcataaatcaattcatcatctacaaccattcagcacanccttgccancantcatgacanagaaagttagtgtaganatatatggcagggctagagcntttcagttatnctancaggtanagntacacnattattttctcttgtcactaacatgtgttacagaacangnaccatntatngnactntacaatatttctnntgcacgtatctttgacgctgctggatggctcgg

SEQ ID NO: 4290 - DNA, 302 bp, Zea mays
  misc_feature: Incyte ID No: 700348167H1
  unsure 27, 44, 48, 82-83, 94, 102, 121-122, 128-129, 138, 160, 166, 168, 180, 187,: a, t, c, g, or other
acacctcgtgccgccgcagcgcttgcnttcgtcccccttacgcnactnccacttggccacttcagacaccatctccctgaanntagtggctaanctcctcancgccatgggcacccctctnntcatcnnccttctcgncaccctccagctgttcactagntcctcncncgcggtcgcgtngtcacanatntncgnatcatntngcagtcgggcctcgacttcgnaaaggagctgctgtatcccatggccgttgcgagctcagggccatgnagtgcnggacatggagaggacatgaggtanct

SEQ ID NO: 4291 - DNA, 302 bp, Zea mays
  misc_feature: Incyte ID No: 700348169H1
tgctgaagatggctttggtgaagaaaatgtcctgttagcatcaaatatgacaaaccagcagttaatggatcaaggcaatcaactaatggatgaaactgatcaagctattgcacgatctaagcagactgtccaagaaaccgtcaatgtgggcacagaaactgcagctgctctgaaagcacagacagaacaaatgagcagagttgttaatgagttggattccatccatttctccatcaaaaggcatctcaattggtgaaagaaatcggtcgacaggttgcaactgatcgatgcatcatggccat

SEQ ID NO: 4292 - DNA, 77 bp, Zea mays
  misc_feature: Incyte ID No: 700348173H1
  unsure 8, 14, 26, 52-53, 70, 74, 76: a, t, c, g, or other
caggtatnatcgcngtctcgcacatnatcaccaagtcagctcatgcaagaanncctttcgttgcatccgntgtngng

SEQ ID NO: 4293 - DNA, 293 bp, Zea mays
  misc_feature: Incyte ID No: 700348175H1
  unsure 29, 37, 39, 64, 73, 77, 84, 89, 103, 109, 125, 139, 145, 147, 149, 182-183,: a, t, c, g, or other
ggtagcgctcctgcaaacatggtgaacgntcctaatncncgccggacattctgcaagaaatgtnggaagcacnaagnccacaangtgangcagtacaagaagngcaagnattctttgtatgcccngggaaagcggcgtnatgacntnanacagagtggctacggccggcagactaagcccannttccgcnnanaggctaganctacananaagattgtgctgagnntggagttcgtngagcccaantgcantntnagagnatgtgcnattaagngatgcaagcnttttgaatt

SEQ ID NO: 4294 - DNA, 294 bp, Zea mays
  misc_feature: Incyte ID No: 700348176H1
  unsure 35: a, t, c, g, or other
tctcatttctgctgttatcggtttggtcactctanttggctctcttgaaatgccaaaggctgatgtatgggttgtaatagcaatcttgtctggtgtgattggatactgtgctaagatatacttcacatttcaacaaaatatgacaatgtatcagaatttgattacaaaatcaatgtatgacaaacagcttgatagtgggaaaggaactcttcttcacttatgtgatgacgtgatacagcaagaagttaaagaggtcataatttgttactacattttaatggagcagggaaaagc

SEQ ID NO: 4295 - DNA, 94 bp, Zea mays
  misc_feature: Incyte ID No: 700348177H1
  unsure 79, 81, 84, 88-90, 93: a, t, c, g, or other
gcggtctcccgagtcccgaagcatccccttccaaaaccctcgccgcgccgcagccacccttgcttccacacaacatacnanagngggnnntgng

SEQ ID NO: 4296 - DNA, 303 bp, Zea mays
  misc_feature: Incyte ID No: 700348180H1
  unsure 50: a, t, c, g, or other
ggatgtttctctccagaaacagtcagatcacaaaggtgatgacatctctnacccagatttactgagtatggatgatgggttagctacatctaaagctcagtcatctgagcctcaacctcctctggtaaatgaaggagttggggcaattaccactaaagtagaaggtgaagtccaccccaacgaggtttccaagagcaggccagcagattggatttcaggatttccagcttcagatggacgtctgcagattataaagaacaatgaccttgaagagctccaagagcttggttctggaactttgga

SEQ ID NO: 4297 - DNA, 293 bp, Zea mays
  misc_feature: Incyte ID No: 700348182H1
  unsure 55, 90, 92, 94, 137, 146, 165, 171, 220, 229, 245, 266, 271, 274, 276, 292: a, t, c, g, or other
cagcgtcggggcaaaaatttcaccgcccttcggtgcatgcttccgctaccgcttnccgaggctgcctacaggcctctcgtcgagcgtgangnanggaggagttggaagaggaggaagaggagttcgaggtgaccaangagggcgangaggttaatcacgagacangaggangcagtggagccaccaggaggcggcggcaacgggttcgggtcgattcgcngcggactangtctcgtcggcgtcanggagccgtctacgagtgatanacgtnaananatggacgatgtccacna

SEQ ID NO: 4298 - DNA, 297 bp, Zea mays
  misc_feature: Incyte ID No: 700348183H1
tatttctgaggcaaacacatagttttttctactctataacagcagtctgttcatatttactgttgaacatgggttacctgaagactgcagaaagaagatgtctaactttttcatgtacttctggcagtttgctgcaaagatatgtcttctaacatcattcagagatacctgttttgttgaaattgttccacaatatcaagctccacagagagagatttggctgagttctggtccgaagttcactataactcactgtacgatgctcgagatctccctagcaatacaagcctagaaaga

SEQ ID NO: 4299 - DNA, 288 bp, Zea mays
  misc_feature: Incyte ID No: 700348184H1
  unsure 45, 63, 207, 243, 248, 280, 282, 285: a, t, c, g, or other
cacacaccacaccacacctcctcgcttccactccgctcgtctganatctcgtcccgtcctttnacttcgaagcctcgcgagccccgacgatggccaccgccgcggtgtcggtcgacgagaagtcgacaagcttcgcgccgaggtcgccaagctcgaaccagatcagcgagaacgagaagtccgggttcatcagctcgtgtcacgtantcagtggggaagcggagagatcgagtggagaagatnagaancctacggatgaggtggtgtgcctacataccgncncgngct

SEQ ID NO: 4300 - DNA, 283 bp, Zea mays
  misc_feature: Incyte ID No: 700348185H1
  unsure 132: a, t, c, g, or other
gatgcgccatcgggacacgccgtcgtcatgctcatgcccgacgggcagaactccattatcatcgtgggcggggcgaacatggagggctgggcggcggggatcggttcggaggacctggaattgatccgaaangcaggcgtgctgctgctgcagagggagatacccgattgggtcaacgcgcaggctgcccaggctgcaaaaagtgcaggagtgcctgttatcatggatgctggtggaatggatactcctttactcgagaatactcagtctagtggatatttca

SEQ ID NO: 4301 - DNA, 246 bp, Zea mays
  misc_feature: Incyte ID No: 700348186H1
ctgtgggcatgatcaacgcaaacccggtggtgcacgagcggccggagcgcgcctcgcacccccacgccgccgatgtgctcgaccctctcgatgtctttgatacggtgcgggacatcaaggacccggagcacccgtactccctggagcagtcagcgtgctgtcggaggagtccgtctccgttgacgagacgctcggacgcatccagataaccttcactccaactgtgcagcactgcatatggccaca

SEQ ID NO: 4302 - DNA, 284 bp, Zea mays
  misc_feature: Incyte ID No: 700348188H1
  unsure 119, 149, 218, 241: a, t, c, g, or other
gttacgttctgtttgtactttattgaagttcattatactattttcttttggtaaagttgttcgcatcaagtgcatgttgcattctttttagtttttaacggttctgctttcagcttgcncttgggtgcgtttattttttagctgtgttnccattcctccaactgtgttttcattcttcctttgttgaccatttcgattttgtggacaactaatttccnttgggtgaaatgatctgacgaantgagatttcgctctatttgttatggacgcatcaagatctaaca

SEQ ID NO: 4303 - DNA, 288 bp, Zea mays
  misc_feature: Incyte ID No: 700348191H1
  unsure 103, 163: a, t, c, g, or other
ccgcagctccaagcaggcaggcgcgggcttggtggcccacctccacgacgacctccttgtggagatcctctcccgcgtccccgccaagtccatctgccggttnaagtgcgtgtccaaggcctggctcgacctcattgccggtcccgaccaccgtaagaagctncgccaacccatgcagggactcatctacatgaatccagagaaagaccgccacagcttcagcttcctggacctgccactgacagtaggatccgtgcctctggacgttgccgaccctgcaggttcatt

SEQ ID NO: 4304 - DNA, 294 bp, Zea mays
  misc_feature: Incyte ID No: 700348195H1
  unsure 17, 41, 65, 106, 109-110, 113, 130, 145, 193, 206, 208, 232, 236, 246, 260,: a, t, c, g, or other
cgtcgccgtcgcctcgncgctcgccgccaccgccgtcccanccctcgtccaggcgcgcggccacngcatcgagaccgtcccagagatgcccctggtcatctccgantcnnctnagtccatcgagaagacntcccaggcgctaaanatcctcaagcaggtcggcgcctacgccgacgccgagaaggccaaggantccgtcggcatcngncccggcaaggttaagatgcgcaancgcngctacataancgcaagtcccgctngtcntctanggtacaganggctcnanggncgtta

SEQ ID NO: 4305 - DNA, 295 bp, Zea mays
  misc_feature: Incyte ID No: 700348196H1
aagcaaggggttccatcattgaataagccgactatacgtggtgatcatctgttcactgttaaagttgcaatacccaagcgcataagtgggcgtgaaagggaattactggaggaacttgcatctttgagtaatggtggctttgctcgaacagatgccaagccaaaacctgcccagccaaaacgtgtacatctagagaaagaagttggtgctagccaagaagatacagacaaatctaaagcagcgggtgattggttgaagaaacttacagattttgctgggtcattgctatggtgct

SEQ ID NO: 4306 - DNA, 314 bp, Zea mays
  misc_feature: Incyte ID No: 700348201H1
ggcagcacaaactattggagtgaaagcaatgatggtgccaattactgctgggatcttgtctgctttaaggagagtattagctcggcgtgtttctctcaagaatcaacttaaaaggcggctccatgctataactattgcttctgctacttgtttccttttccgtttgccatgtgggatacgatcctaggttcggcatctgacagcattgttaaattacaactaccaagttgggcatactttagtactgttttattggaatggtgcttatattcatgttgacaatgttgctgaagaaaagttgcactggcttctct

SEQ ID NO: 4307 - DNA, 318 bp, Zea mays
  misc_feature: Incyte ID No: 700348203H1
  unsure 142, 144, 170, 201: a, t, c, g, or other
ccagccgccaccaggtgcagagtctttcgtcatctcttctccggcgaagaacccccagtcgcccaccagatcacttgttaaactttgttgaggggtgatggcggtttctttcgcaaacctcagctccgaggcagggcttaanangcttgatgagtaccttctcactcgcngctacatcactggctaccaagcttccaaggntgacttggctgtctacacttcgttttcgtctgctccctcgtccaagtatatcaacgtagcaaggtggtttaatcacattgatgcgctcgtgaggctgagcggaattatgcagagggc

SEQ ID NO: 4308 - DNA, 316 bp, Zea mays
  misc_feature: Incyte ID No: 700348204H1
ctgatcattttcctaaggaacagacttaagtatgccctgactggagatgaagtaaaaaagatttgcatgcagcgattcattaagattgatgggaaagtcaggaccgatataacctaccctgctgggtttatggatgtcatcagcattgacaagactggagagaacttccgtctgatctatgacaccaagggtcgctttgctgttcatcgaattacacctgaggaggccaagtacaagttgtgcaagtgagcaagatctttgtgggcacaaaaggaatcccacatctggtgacccatgatgcccgtactattcgata

SEQ ID NO: 4309 - DNA, 311 bp, Zea mays
  misc_feature: Incyte ID No: 700348208H1
attgtggtgtttgatggaaatgcatatcatggtgaatctgcacccaacaagaaagatgcagagcagaatgcagctcgtgttgtgatcaagtcgattttagctaagcatgacacttgtatggtgagaattgttagatcgaagaaacaacttataactgctgtcagatcttctggaaacaccccagctacttttactcctatacagtttacacggcctgtttcatatgcagcatatggcagaccagatgatacaacacctgttttgccaaatgaatcttcctcattagctgttcaacgaggcatcaatgttgt

SEQ ID NO: 4310 - DNA, 310 bp, Zea mays
  misc_feature: Incyte ID No: 700348209H1
  unsure 29: a, t, c, g, or other
ctctctcttgctcagttttgggactacantgttttgctgttttagaaatcagaaagaaaggaattcatacggggatgtttgaacaatggaaacaaagattcatgtgtaaagctttttttttgcatgtaagttattgcatttcaaaggaccccgcccctttttttacgaaaagaacccttttttgcgcaactgtggacactatcaatggtgccttgaaatctatgacctcaacttttcaaaaagacttttttcaatgttattttaaccgtgtaaataaggtagatagaggaattaaactgtatattctgga

SEQ ID NO: 4311 - DNA, 308 bp, Zea mays
  misc_feature: Incyte ID No: 700348210H1
  unsure 35, 108, 221: a, t, c, g, or other
gcagcgttggcgggccttgtagcgaggagggggtncggaggcgcggcgactgttcgcgggatgagcttcggcggcagcagctccctcgcatcaggtgcgaagaggcgntcgagtacgggagaacgcatgtggtgaggcccaagggcacgcacaaggccaccattgtctggctccatggacttggggacaatggagccagctggtctcaactactggaaacncttccccttcctaatataaaatggatatgccccactgcaccttcaagacccgtgtcagtgtttggcgggttcccctccacagcatgg

SEQ ID NO: 4312 - DNA, 291 bp, Zea mays
  misc_feature: Incyte ID No: 700348213H1
acgtgggagctgggacgggcaagtagtagaaaccttctctccttccccagccaggacgccatacagaatccgacgcgatccagaagaagccaaggcctcttcagatcctcccgcctccctctgcgaggttcccagaccgagccatcgccggcgctaggctcggggatcttgtcgggtcccgtcccgtcctaccacttcgccggcgctgcgtcgccgtcactcgtcagtcaggatcaggatccccaagatggcttcttcaaacggtgaggctgagcaacaatggatagagat

SEQ ID NO: 4313 - DNA, 305 bp, Zea mays
  misc_feature: Incyte ID No: 700348214H1
ggaggttggaagtgaaacagttatagacaaaagtaaatccatcaaaacttggctgatgcagatctttgaggaaagtggtaacagtgacattgaaggtgttgactccagcaatgcatgttatggcgggacagcagccctactgaattgtgtgaattgggtcgaaagtaattcctgggatggccgttatggtctgtcgtttgcacggatagcgcggtttatgccgaaggccagctcgtccaacaggaggtgctgctgctatagcaatgctcatggtcctaatgctccaatttcctcgagagcaaata

SEQ ID NO: 4314 - DNA, 308 bp, Zea mays
  misc_feature: Incyte ID No: 700348217H1
  unsure 153, 173: a, t, c, g, or other
gaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttganacctacaccttgtcaaaagncaacaattggttatgaatgtcgatggtgcgatcgggtccctttctggatctctatctggaagtggaatgttcaccaaacaggagatcgatgagattgtggagatcggttatctcatgggctcttgtgctgcacga

SEQ ID NO: 4315 - DNA, 313 bp, Zea mays
  misc_feature: Incyte ID No: 700348219H1
gtggtgcccttcgccggtgcgcgcccgccgccgcacctcctcccacgcatcctttcctcctcctttggtacatctcccgcgcgaccacaggtgggggcgctgctggagctcccggaggtggagaaggtactgcgcgacgtacgagcgggtggcgtgcgcgtattccccgtcggcgagagcggtctgcacggcggggcctgcgccgactacatggtcgtcgccacaggccgctccgattggcacgtccgtaacatcgcgcagcgctcctctacaagataaagcaaaagcagaagggctctgatagaatattgat

SEQ ID NO: 4316 - DNA, 307 bp, Zea mays
  misc_feature: Incyte ID No: 700348220H1
agccatctaaggaggaggtggcctgttcatattgtgaaacatcatgatgcttattttgggcatcttaagctatcttctctggcacatcaatgatttcatgagcttcaaggcccctttattttaaaagttgattctttgcataatcctctctgtgggtgcctacaaagtttaaatgtggacatggctgtcactactcactagtctcattgaagcatcatggtgcaaatcctgcttcaaggtctgctattgatagcttagagatggctgtgatgtcaacgcctcagcattaattggacttctaggcttc

SEQ ID NO: 4317 - DNA, 305 bp, Zea mays
  misc_feature: Incyte ID No: 700348224H1
ctcaaacatgtgttcagttcccacttgagcttcttggttgcaatggcactgccattcatgcatataccgagacatctacaagctcacctcctgcgcaagaatcctcttacttaccaccgtagtttcaaaaaagacatttcaagccccaactccgtcctggagccacatagtgaagagctccacaagatacatcttggtctttcctctggtgtggaggatgcaacaaaatgggagcatataaacataaagagcatagaaccagatggtgcctatgtgattgctagccaataaatctcgttgaggaa

SEQ ID NO: 4318 - DNA, 303 bp, Zea mays
  misc_feature: Incyte ID No: 700348225H1
  unsure 257: a, t, c, g, or other
ctcccagtgggtgatctggctttacctagctatcatgacctgaagacttctgataacaaaaaagtgaaaagagggtcattttctggtccaatagcttccagaccacggtcaacagagaacattgatgttatttctgcagcgcctaggcatagctcagcacatcagccagtgcatatgagagtatcccccggcaactcgccgccacccatttcctcaccgaagatcaaggaacttcatgagcttcctcgaccacctgntaatacatcaaaaaatatagcttccccagtttagttgcccatccgc

SEQ ID NO: 4319 - DNA, 301 bp, Zea mays
  misc_feature: Incyte ID No: 700348226H1
ggtccttgaagaagtctgctgccctctggatggatgcttactatgaatgatacagagccttgcatttattagtatctctgaagaaggtggtggctgtgcatgtgcttttctctgattaactgagaattaactggcaaaagtggcatacatgagtgtcccaggaatgtgagtcccaaggacacatattaacctttccctgaaggtcttctctgtaactgagaggaagaagaaacagaaaagtgacttctgtcagaatcacaaagggaagacactagctcactgttttcacattttcataggg

SEQ ID NO: 4320 - DNA, 301 bp, Zea mays
  misc_feature: Incyte ID No: 700348228H1
  unsure 7, 21, 61, 188, 261, 264: a, t, c, g, or other
gttgttngagtagcaacaggntcacaattccgattcagattctgaggaagagatggttganggcaacttgaccatccctgacagaaaggagagctatgaacttccatcgcaagctgatctcatacgtcaggcttttgctggtgatgatgttgaagctgaatttgagaaagacaaaatggatgttttanatgaggagaatcctgaacctgaaaagcctgctcttgttcctggctggggccagtggacagacatccaacaganaanaggacttccctcatggatgataaaagaacatgaagtt

SEQ ID NO: 4321 - DNA, 303 bp, Zea mays
  misc_feature: Incyte ID No: 700348229H1
  unsure 30, 82: a, t, c, g, or other
ggcgacgaaaatggctccaacgaccgccancaaggacgacagtggctacggcgacgagcgccggcgcgagctgcaggcgttncgacgacacgaagctgggggtgaaaggcctggtggactccggcgtcaagtccatcccgtccatcttccaccacccgccggaagccctgagcgacataatttctccggcgcctctgccgccgtcgtcgtcgccctccgccgccgccatcccggtggtggacctctcggtgacgcgccgcgaggacctagtcgagcagtgaggcacgcggccgggacgtgggc

SEQ ID NO: 4322 - DNA, 305 bp, Zea mays
  misc_feature: Incyte ID No: 700348232H1
  unsure 15, 18, 29, 40, 50, 62, 88-89, 92, 172, 227, 233, 235, 241, 261, 264, 270,: a, t, c, g, or other
acagtgacatcgatnacngtgagattgcnctacagcactntgtctttganagagcacaaganagggaagcacatcttgtttcaactannggnaaaggacgtgaagaagattatgcaccagaatcaactgggagttcaacgatgccatttcatgcagtccccgacctgcttanctgggaagatggagatggtgacaacagccttggtgctaaaccttctttccaactnaacacngnagttanatgctcagaatgggtttctnctnccaagncacctgtggagggcgatctgnttctggggacttct

SEQ ID NO: 4323 - DNA, 297 bp, Zea mays
  misc_feature: Incyte ID No: 700348236H1
  unsure 189: a, t, c, g, or other
gcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattccttataccagcacattgccaacctagntgggaacaagcagttagtgttgcctgtccctgcatcatgtcatccacggtggttcccatgctggaaacaagcttgctatgcaagagttatgatccttctatggagctg

SEQ ID NO: 4324 - DNA, 289 bp, Zea mays
  misc_feature: Incyte ID No: 700348237H1
  unsure 10, 20, 81, 84, 131, 192, 231, 251, 268, 270, 280: a, t, c, g, or other
aacaccaccncgaacaaganagaaacacggccgcggcggggcggggcggggcggcttctccttttccaactcgctgcccgntgngtgattccgccgcgtcgcgtcgcgtgtgcatttgcgcgcgcgcgcangagccgccgctccgatcgccctgaaaaaggtgccaattgttactgattccagataagtgtncctacgctggcactaactgcgccgcgaccttcttcagcnatcttatgctcatgtctcanctcaacagatggctaanantaggaagccncctggcctc

SEQ ID NO: 4325 - DNA, 299 bp, Zea mays
  misc_feature: Incyte ID No: 700348238H1
  unsure 41, 77, 87-89, 282: a, t, c, g, or other
ctcgttccatttccccatctcccagatccaattcgcgagtnctccctcctctgcggccatggcgctctctgtggagnagacctcgtnnngacgggagtacaaggtcaaggatctctcgcaggcggacttcggccgcgccgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcancgcgctcggcgccgagg

SEQ ID NO: 4326 - DNA, 290 bp, Zea mays
  misc_feature: Incyte ID No: 700348243H1
  unsure 60: a, t, c, g, or other
tcgactcggtgggctccatcttccgcggcaggacgtcctgccctggtgcgatcccgacancatcgccggtttcgagagtgaggttgctgaggctgcaaatgaagaacagaaaaccgagagcctgatgaggctctcctgggcgcttgttcactctagacagcctgaagacgtcaaccggggcatcggatgcttgaagcttcattggacaggtctagcagcccagaggaaacaagggagaagctctacttgttagctgttggtcgttacagaatggggattatacaagaagc

SEQ ID NO: 4327 - DNA, 294 bp, Zea mays
  misc_feature: Incyte ID No: 700348245H1
  unsure 6, 9, 57, 150, 234, 256, 274, 287: a, t, c, g, or other
accagnagnagctctttgtcgcagccgagggcatgtacacgggccagttcgtctacngcggtcgccgcgccaccctctccatcggcaacgtgctgcccctccgcgggatccctgagggtgccgtcgtctgcaacgtcgagcaccacgtcngtgaccgcggtgtcttcgccagggcctctggggactacgccattgtgatcagccacaaccctgacaacggcacatcgaggattnagctgccctctggcgccaagangattgtccccagcagctnccgtgtatgattnggcaggt

SEQ ID NO: 4328 - DNA, 288 bp, Zea mays
  misc_feature: Incyte ID No: 700348246H1
  unsure 52, 158-186: a, t, c, g, or other
agtgccaattgcgtggtttttgccgaggaagttgtttactggttaatcttanagctaggatggtgggcgcgcctccgcaaggaccacaatgcctgttctggctacgtgctgatgaacaacaaaaatgatgctgtattttgcagaaccactgttacctnnnnnnnnnnnnnnnnnnnnnnnnnnnnnccaaaaggagccgtattcccagtagaaattttgtactggacagaggcacggttccaaaaggttcggccctaaaaactgctctgcaatgtcagtggtccagcg

SEQ ID NO: 4329 - DNA, 294 bp, Zea mays
  misc_feature: Incyte ID No: 700348247H1
  unsure 64: a, t, c, g, or other
aaaccctcctccagtgctcttttcttctagccgccgccgcaaccgcttgctagcgctctgcgtnctacatcctacgcgtccgtggaaggtcgtctcgacatggcctccgagacggagacgttcgccttccaggcggagatcaaccagctgctatcgctcatcatcaacaccttctactccaacaaggagatcttccttagggagctcatttcaaatcctccgatgccttggataagatcagttcgagagtttgacggacaagagcaagtggatgccagccggagtgttcatcca

SEQ ID NO: 4330 - DNA, 299 bp, Zea mays
  misc_feature: Incyte ID No: 700348248H1
  unsure 2, 8, 15, 57-58, 79, 269, 274, 278: a, t, c, g, or other
cnaagggnatgtgtncaaaaacaagcggattctcatggagcacatccacaaactgannggcagacaaggcccgcaagangctactggctgaccaggctgaggctcgcaggtctaagaccaaggaagcacgaaagcgtcgggaggagcgcctccaagccaagaaggaggagatcatcaagactctgtccaaggaggaagagaccaagaaatgaagcgtccctcgtgtctgtacatagtggccaggctgtggcctcagtggatcatcttanaatanaacnagcctttgtccttgaaaagaa

SEQ ID NO: 4331 - DNA, 108 bp, Zea mays
  misc_feature: Incyte ID No: 700348249H1
  unsure 88, 93-94, 100, 102, 107: a, t, c, g, or other
ccagtgttcgtggtttcaaacgaaattcagttaataagactaaatttgcgtattcaaatggattgcgtggctgcctggttaaaaaaanagaanngcgaanangtggng

SEQ ID NO: 4332 - DNA, 310 bp, Zea mays
  misc_feature: Incyte ID No: 700348251H1
  unsure 289: a, t, c, g, or other
ctccgttgcaataggagcctcccatgccatgtgcttggtctccacgcaacaaaccgagaagtagggcagtctgggtttctgctttgtgaaggcacttatgtttcggtattcatacgtctgagtcagttcgaagcggaccctgttctcttttgatttgatccagctgttcctgttggtggaaactggaatccctgctcggttaagctgaacacatctggaagaaagaataaaaaaactgccacacgctgatagaaagcaggaaaggccccctgtggctggctccgggtangcatagctgtagtagattcga

SEQ ID NO: 4333 - DNA, 113 bp, Zea mays
  misc_feature: Incyte ID No: 700348253H1
  unsure 38-39, 42, 46, 52, 68, 73, 83-85, 107, 112: a, t, c, g, or other
ctctgaaaagagtgaatttcacaagttacagcaactgnnagntgancaaggngaattgtccagcagtnatggncaacaatacnnngcactaatagcgtgccactganagagng

SEQ ID NO: 4334 - DNA, 306 bp, Zea mays
  misc_feature: Incyte ID No: 700348254H1
  unsure 60, 140, 177, 229-230, 237, 239, 241, 255, 258, 263, 270, 277-278, 282,: a, t, c, g, or other
cccgttttctctgcgcaggatttgggtatagcggagatgtctaagagcctgctccaggcngcgcgcctgcagaaactgaacaaggccggcgtgcgcgcgggccccaaggagaggaagaagttcgacgccaccgaggtgcngcgttcttcgagggcgaagaccacggtttcctacaangacgatttcggtgaactagatgcttttctgcgtggcacaaggcgcatggtgnnaggaatncngnaacatggaagagangcnctggnagaattncatcttnnaaanagnaacaacgtgctttnagagagg

SEQ ID NO: 4335 - DNA, 157 bp, Zea mays
  misc_feature: Incyte ID No: 700348255H1
  unsure 24, 28, 51, 108, 119: a, t, c, g, or other
ccgtactcgggtttgttcctcgcntcgnttccttcctccgcagtcctcgtntcgaattcgctcgcggtgggagaaatcggggcgcgaggatgaccgtgatcgacatcntcacccgggtngacgcgatctgccagaagtacgacaggtacgacgtcga

SEQ ID NO: 4336 - DNA, 299 bp, Zea mays
  misc_feature: Incyte ID No: 700348257H1
  unsure 94, 133, 152, 167, 190, 193-196, 205, 214, 217, 241, 245-246, 248-249, 251,: a, t, c, g, or other
ggcttggattgcaaaagagtcaacaactgcagtgcacctttatacagcaatccctgtggtgatttctcttatcggtttaataacatcaacattncagattccatcaatcatgatgactcaataaaacaggaanaatgtaactctattgctgnagagaaagcgataangtctatttctggtgggttgctanatnnnnaaggctcangtcatgctngtnctgatgattcagtaagtgtgatancagnngnnanttctnnggnnttattcaagatctcgccagcnncgagcgtcagccctng

SEQ ID NO: 4337 - DNA, 297 bp, Zea mays
  misc_feature: Incyte ID No: 700348259H1
  unsure 212, 261, 264, 278-279, 286, 290, 296: a, t, c, g, or other
gcgggcagcagcacacagccccatcccaatcctagtcgatcttcttcccctcctcaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaanatcttgtagaatctgtcaggaaaacttcagcacaatgttatgcactcanganctattgatataagnnggaaggnttanggtttng

SEQ ID NO: 4338 - DNA, 299 bp, Zea mays
  misc_feature: Incyte ID No: 700348261H1
  unsure 86, 171, 180, 194, 198-199, 204, 217, 226-227, 233, 237, 240, 242, 247,: a, t, c, g, or other
ccatttcaacttggcttacaagacgccacatcacctatcatagaagaacttacaaactttcatgaccacaccctaataattgtatncctcatcagctccctagtactttatattatttcactaatactaacaacaaaactaacacacacaagcacaatagacgcccaagangtagaggcnatttgaagaaatcntccnngggtngtgcgtggccganttgcccttnnatcccngggnttngngacgngngggnnggagnagtgncngntggaggagaggnnganggngncgngtgtcng

SEQ ID NO: 4339 - DNA, 294 bp, Zea mays
  misc_feature: Incyte ID No: 700348262H1
  unsure 12, 90, 208, 213-214, 219-220, 226-229, 231-232, 234-238, 241-242, 252,: a, t, c, g, or other
gcgatgacagangcagcgtccgcccacttttcccctcgcgcggccacgacggatggtagtcggatccgattgatcgacctggaagaatcnccaccgtcctgctttaccgagcgagatgctcggatcctgcagcgaagggagagagtgcatcgccgccgccatccgtgtccgccagtgcttcatctccgaagcgtcgtctgaagggganacgtnnattanngtgggnnnngnncnnnnnganntggtgtttgnagaaannangagntggagtnttgtttngggnganaaaacang

SEQ ID NO: 4340 - DNA, 285 bp, Zea mays
  misc_feature: Incyte ID No: 700348264H1
  unsure 37, 139, 143, 169, 194, 203, 205-208, 215, 219-220, 222-223, 225, 227, 243,: a, t, c, g, or other
cagcgggcgctttacgctccatggcaagccgcgttanatgcctcaggtaccggcatctgggccaattcgccccactaggagggaaacaaactgctgcacagcttcccggggactggatctccattgaagtttgcagganatgntcttgatattctttcacgagcaccantctggagaaagggtcttgaataatngcatggacngnnnntggactngggnnanntnanatttccctaagagccncncagnaaatgnggnnnnncaagggttgaacnnangnngnna

SEQ ID NO: 4341 - DNA, 120 bp, Zea mays
  misc_feature: Incyte ID No: 700348265H1
caaaaacgtgtgaggagggaagagggtgcagacctcagctcagctgcctgttgaacttgtctgggtcatctcggcacccccgctttgccagagccccctggccagcatgtcttccacaca

SEQ ID NO: 4342 - DNA, 298 bp, Zea mays
  misc_feature: Incyte ID No: 700348268H1
  unsure 51-52, 291, 296: a, t, c, g, or other
gacacccagctcatcgcccacgacaaggaggtctacgacatcgcctggggnngcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtgttntcttnaa

SEQ ID NO: 4343 - DNA, 304 bp, Zea mays
  misc_feature: Incyte ID No: 700348269H1
ctactgtgcacaaagatagtacaccagaggcatattccaccttttctatttccaactcaaaagcgtcaaaaaggaagcaaggtgccatgtctggagcaaaaggtggaaaccctttactcactttgggtctaggctgctcaccaagttcatcttataacagcaagctaagttctggcactgcttgcataacatcatcatctctattaaaggagattgatgaagagtcttcaatagatcttggccttaaccttgggttgtatattggaaatgatattggacactgccaacagaaatcccatgctgg

SEQ ID NO: 4344 - DNA, 301 bp, Zea mays
  misc_feature: Incyte ID No: 700348271H1
cagacccttgacaaggatcaaggcatttcagttctcactactgcagtcaaggcttgtacagcagagattgaaaagtacaaaggaaagttagtagtgaaggaaccaccaagagctgttagtgagcgggaagacaagctattcctcgaccagattgattccctaatggagcaaaacgcagaggtcgatggtgatgctgacagtgaagaggaggaagatacaggaatgggggacgtcgacattacaaattctggcgtcgctgcttactaaggctacactggttgatttggatgagctttgctgt

SEQ ID NO: 4345 - DNA, 299 bp, Zea mays
  misc_feature: Incyte ID No: 700348272H1
  unsure 6, 8, 10, 12, 63, 87, 187, 190: a, t, c, g, or other
ggagananananggccccgcagcggcggaggcggagatgggggcgtcggatctagaccggcanatcgagcagctgaagcggtgcganccgttcacggaggcggaggtcaaggcactgtgcctcaaggccatggagatcctcatcgaggagagtaacgtgcagcgcgtcgacgcccccgtcaccattngtnggcacatacatggacagttctatgacatgaaggagctgttcaaagttggaggtgactgcccaaagacaaactatttgttccttggggatttgttgaccgaggattttat

SEQ ID NO: 4346 - DNA, 115 bp, Zea mays
  misc_feature: Incyte ID No: 700348273H1
  unsure 24, 43, 48, 53, 56, 75, 108: a, t, c, g, or other
tgacttccctaattccccccatcnttaccaccctcgttaaccntaacnaaaanaantcatacccccattatgtanaatccattgtcgcatccacctttattatcagtntcttccg

SEQ ID NO: 4347 - DNA, 288 bp, Zea mays
  misc_feature: Incyte ID No: 700348274H1
  unsure 73, 85, 177, 195, 208, 229, 244, 248, 251, 263, 266, 269, 277: a, t, c, g, or other
tccctcgccttcgccgccgaatccgagactccgatctcgggttcaccgcagcgcacagagcagccccgactanccggcccgatcngcgctctcctctccgtcgcttcagtcatggcaggaatggcacctgagggttctcagttcgatgctaagcactatgattctaagatgcagganctgctgagcaccggtganatgaggagttctncacttcattgatgaagttttngagagtttgatgatngggnctnaagagattttcnganggnaatggagntagggttaaga

SEQ ID NO: 4348 - DNA, 295 bp, Zea mays
  misc_feature: Incyte ID No: 700348275H1
  unsure 44, 75, 130-153, 264: a, t, c, g, or other
ctgcgtttcgccactgagatagccaaccctgcgactgcgtgcgngcgggcgagcgagcgagcgagcaggcagaanggagcgccacgcccagaaccagaagcaggcgccgctagtcctcgcgctgtcctgnnnnnnnnnnnnnnnnnnnnnnnnctccgccgtccccactccaagaagcctgcgcctggggggccagcagcagcacccgccggctctgaagctcacttcttctcaggaggcggcgatcgcggcggcgatgaaatnggcagccgaggcaaggttgccctgaagttaa

SEQ ID NO: 4349 - DNA, 294 bp, Zea mays
  misc_feature: Incyte ID No: 700348277H1
  unsure 84, 101, 280: a, t, c, g, or other
atcgacgcacgcagccgcgacccatcgcgacctgacccgaccctcccgaggccgccagccttatcctctccgcctccgcctccngccgtcccccgcgaccnatcgcaagcgcgagtagaagacatggcctcgacgttcggtgccacttctacagttggccttatggctgctccaacggggaagaatgtgcgccttcagaggagggctaacttcagagtaaaagcggtaaggagtgtacttcaacaaggatgggtcagtataaagaagctccagactggancaataagttgcagg

SEQ ID NO: 4350 - DNA, 288 bp, Zea mays
  misc_feature: Incyte ID No: 700348278H1
  unsure 51: a, t, c, g, or other
gttgcttgcaagcaaacactgacgtcattgttgcgcctgctgaatgcttanaatgatgagtctgattacactgtactttcacatgtaacctctgtatgtttaagcatttctaaaataacagttgacgctactcctgacctgaacaaagatatcaaacagcttttgatcaaccttcttctcccagctgtcataaagttaggctgggaccccaaggatggtgagagtcatcttgatgtaatgcttagatcactgctcttgactgcgctggtcagacttggacataatgaa

SEQ ID NO: 4351 - DNA, 289 bp, Zea mays
  misc_feature: Incyte ID No: 700348279H1
  unsure 216, 232, 247, 249, 251, 263, 274, 278, 283: a, t, c, g, or other
ccagacctccatcttcgtgaccttcgtaggcggcgagcacccaccaggagaaggcatggcttcacgcatgacaccttccaagaggccttttcagagaagatcttcagactacgatggccggggcaagtggcagaagacgaagcacccttctccacataaatctcagttcaaaatcgagcctggtgttcccattttccgtattctctgccgggcttnaaaatctggtaatgtnattggaaagggggtncntnttaaaatttcgnaaaaaaccggnaaanggggntggggc

SEQ ID NO: 4352 - DNA, 289 bp, Zea mays
  misc_feature: Incyte ID No: 700348280H1
  unsure 272, 279, 283: a, t, c, g, or other
ctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgnctttacnctcngtgtta

SEQ ID NO: 4353 - DNA, 296 bp, Zea mays
  misc_feature: Incyte ID No: 700348281H1
  unsure 257, 263, 273-274, 278, 282, 289, 291: a, t, c, g, or other
gggacataaatcctccagcagggattaggcaggctatggagatgcaggctgaggcagaaaggaaaaaacgcgctcaaatccttgagtcagaagggatgaaacaggcccaaatccttgaatcagaagggaaaaagactgcccagatccttgaatctgaaggagctatgttggatctagcaaaccgtgccaagggtgcggctgaagcaattcttgccaagtcagaagctactgctcgtggaatgagattggtttcaganggatgnccattgaggnnttcnaggnttaaccncnaattg

SEQ ID NO: 4354 - DNA, 248 bp, Zea mays
  misc_feature: Incyte ID No: 700348283H1
  unsure 43: a, t, c, g, or other
ctgagatgcctccgctggaggatgacgccggcgaaagcaaganggaggaggtcgactaagcttcggatcactgtcgtttatccctaattacatatgataagctaaatcttgactactgtttgaggttttccgcacgttaacggttctcctgccggccaggcaatgagtttgttgtatagctatatggtactctgttttacagtttgttcttgttatctgtaatcctactagtatagtacatgttctac

SEQ ID NO: 4355 - DNA, 289 bp, Zea mays
  misc_feature: Incyte ID No: 700348284H1
  unsure 228-229, 237, 241, 245, 248-249, 254, 256-258, 260-261, 263-264, 266-267,: a, t, c, g, or other
ccaccacaaggcgcatactgccggccttggttcggcaccgcgcgttagatcccagggccaactaggttgttctctaattcctaatttcttggccttttctcttccactctccgaccattttagctgtcgcctcggttgttttagcttgccggcgtggacagactggcagatctggagctcggcgcgaccagatccggtgctgctgtgcccgatggcagaggagttctnnggtttacncggntaanagnnaaagngnnntnntnncnncannaggtngnntncnnaaacc

SEQ ID NO: 4356 - DNA, 293 bp, Zea mays
  misc_feature: Incyte ID No: 700348286H1
  unsure 27, 47, 77, 81, 96, 123, 252-253, 281, 290, 292: a, t, c, g, or other
gaaacgaccgcgaagcacaggtcgaangcggcggcggcgatggggancgacacggagacggagaagaaggcctccgnttcngctgatgtccatcgngaaacccctcgctggaaagaagctctncaagcggaccctcaagctcgtgcgacgagcctccgaggcgaagtgcctcaagcgcggagtcaaagaggtagtcaagagcattcgccgcgggaacaaaggattgtgtgtgatcgctggaaatattgctcnnattggtgtgattacacatgttccgatantatgtgggnanc

SEQ ID NO: 4357 - DNA, 292 bp, Zea mays
  misc_feature: Incyte ID No: 700348287H1
taaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgggcatggaagaacgaaccgaggggcctcctgcttctggacaagcgttcaggcagcgtggacac

SEQ ID NO: 4358 - DNA, 291 bp, Zea mays
  misc_feature: Incyte ID No: 700348288H1
ctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgc

SEQ ID NO: 4359 - DNA, 268 bp, Zea mays
  misc_feature: Incyte ID No: 700348289H1
agcagcgcctgagctccagcaataatggccgagaagggcgtgaaggtgttggggatgtgggcgagccccatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgagtctggaagggcgg

SEQ ID NO: 4360 - DNA, 284 bp, Zea mays
  misc_feature: Incyte ID No: 700348290H1
  unsure 169: a, t, c, g, or other
catcttactgtcccttgcatttgtagttgcttggaattatgacgtctttagcacgatctgaagtagggagtatatgtaccacagaacgtctaggaattttgttgtagcagttcatctgagtatatccacttactcttaccatgtgcgattaaagtgcacttgagtttgnttacagcttgaaatgtccgcactggtagcagacatggcagattgttagggcacctatggagacgacgtcaaacacatttgagttaggggaacttgatatcgacgggggcactgat

SEQ ID NO: 4361 - DNA, 90 bp, Zea mays
  misc_feature: Incyte ID No: 700348293H1
  unsure 37, 70, 75-76, 78, 85: a, t, c, g, or other
cgcccactttgtttgtgcattaaggactgaccatatnctttgcctgtacccagagtgatataaaagtggnctggnnanaattaancttgc

SEQ ID NO: 4362 - DNA, 284 bp, Zea mays
  misc_feature: Incyte ID No: 700348294H1
  unsure 220, 235, 237, 244, 247, 262, 264, 267, 269-272, 274, 281: a, t, c, g, or other
gctggcaggttagccctgacctctatggagacaacaacaccaggctgttcacatattggactagtgatgcataccaagccacaggttgctacaacatgttgtgctctggtttcattcagataaacagcgaggttgccatgggggctagtatcttccccatctcgaactacgcgggctcccaatatgatattagcatcctgatctggaaggttagcatttngcagttaagtactcntngggcccnacnatttaggggcctttnanatncnnnncnggccccnggg

SEQ ID NO: 4363 - DNA, 287 bp, Zea mays
  misc_feature: Incyte ID No: 700348295H1
  unsure 226, 271, 277-278: a, t, c, g, or other
ggccgataaacaatacaacatagccctactccctgcctaacaaaaactcataatcatctagtctgaactgtgatggatatcccatgcgtaattttgttatactgaattcgttaagtttgcaggacatgctcttgatattctttcacgagcaccactctggagagagggtcttgactatcggcatggtacaggccatggaattggatcttatttgaatgtccatganggtcctcatctattagcttcagaccttctgctcgaaatgtccgcngaacannaatgatggg

SEQ ID NO: 4364 - DNA, 253 bp, Zea mays
  misc_feature: Incyte ID No: 700348301H1
ccactgcacgcgataattagttgcctgttaatatgtagatttgcaagtatataatttatataattttgttgaggctgtgttggctgaactttgtcatctgcttcttcagaattttcaacacggggctggattttggagtgcaccttctagtcaaggaatgtgctaagcaagaaatttatggtgaatgaattattacttttaaattttcttgggtaatcaaagcaatcaactaattgatatgtttagtttctgt

SEQ ID NO: 4365 - DNA, 303 bp, Zea mays
  misc_feature: Incyte ID No: 700348302H1
  unsure 208, 236, 251, 255, 260, 262, 274, 280, 284, 286: a, t, c, g, or other
cctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacggggganttccagctccgacgccaaggagaacgcngatcccaacccgaancaanagttnanggtggaaatagntacgtncggnanaagccgagcttgacgac

SEQ ID NO: 4366 - DNA, 305 bp, Zea mays
  misc_feature: Incyte ID No: 700348303H1
cttgagatggaattgctagaagattataacaaaaggttatctaaggcatcaccaaaggaaaggaaaataccgaacttgcatgttacacaggcgggcactgcagaagtgttctcaagaaacacagctgaagtctccaggtgttcattggcagcaactggagaatgttttgatgattctgaagatcttggaagttcaagacacgctgatagtgtacttggcatagatattaaagagtgtactgggtgttccatatctacatcttcatcagggcacaagcaagttacgagaagatttgtgttcggatc

SEQ ID NO: 4367 - DNA, 298 bp, Zea mays
  misc_feature: Incyte ID No: 700348307H1
  unsure 21, 40, 42, 55, 57, 59, 79, 111, 115, 120, 151, 155, 187, 194, 212, 214,: a, t, c, g, or other
tcgaaccctctcgcgcttggnttgctttcactctccaggncnccactcccacctncncngccgcagccatggcgatcanagcgccaactcccgacatcctcggcgagcgcnagtncggcnaggacgtccgcacgcagaacgtgatggcttntcgngcggtggccaacatcgtcaaatctcgctcggncccgttngtctcgacaagatgctantngacgatattggtgatgttacaatcataatgattgagcaaccatacttaagntgttggaattgagnatccagccgcnaaggtttt

SEQ ID NO: 4368 - DNA, 236 bp, Zea mays
  misc_feature: Incyte ID No: 700348308H1
  unsure 206, 232, 234: a, t, c, g, or other
gaacggatcaagtatcaaggtcttcatcatggatccagctacttggagcacctcaatttcttgtctgctataagggctcaaggtgcatccggaccatctgtgaacttaagtgacggcctactatctgttgccgtcggtgtggctgggcaattatcaatcgagcagggccggtttgtaacccatggaagaggtctaaggttgtagcnggtgataattcaggcctcctaatggnangg

SEQ ID NO: 4369 - DNA, 294 bp, Zea mays
  misc_feature: Incyte ID No: 700348310H1
  unsure 200, 216, 232, 236, 244, 249, 284-285, 293: a, t, c, g, or other
gccatatcaaacatggttgagaaagtaccttcattcaaaggaggtggaacattgtggtttactgacctgacgactccagattctctttacatcttgcctatgttaacaggactgaccttcttggccacagtggagcttaacttgcaagaaggaatggagggaaatcctatggctggtaaaatgaagtactttctaggggngaactgttttgaaagncccctttacaatgaanttgncacggcantttcnggtactggacctcatcaaacatattcccccggtannggcctggng

SEQ ID NO: 4370 - DNA, 300 bp, Zea mays
  misc_feature: Incyte ID No: 700348313H1
  unsure 197, 206, 211, 285: a, t, c, g, or other
caaactggataaatgtgtgaaaagtggagcaaagatagttctgtctcggctagctattggtgatcttggaacacagtattttgcagattcgagacattttctgtgctggccgtgtcactgaagaagatttgcaacgtgttgctgcagcaactggtggaactgttcaaacttctgtaaataatgtcatcaatggatgnactccggtncctgngaggtattcgaggaaaagcaagtaggcaatgaaagattcaacatatttagtggctgcccttctggccagacagngataatgttctccgg

SEQ ID NO: 4371 - DNA, 221 bp, Zea mays
  misc_feature: Incyte ID No: 700348314H1
  unsure 9, 13, 79, 201, 203, 210, 220: a, t, c, g, or other
cagcgagcngcantcctcctcgtctctcaaagtcgagccgccactcgattaagcgattccaaggcggacggtgaggtgntcatggagtacaggagggtgaaggatcacgagatttatgatgatttatctcagaaggatgtggaaagcctgagtgggaggacactatctagtgccaatactacagtattggtcccgcttttnangagggcnaaaaaccaant

SEQ ID NO: 4372 - DNA, 297 bp, Zea mays
  misc_feature: Incyte ID No: 700348315H1
gctgattgcagatctccaggtgggatatacttgcacgggcacagaaggatccagatctattcaagcctacaatgacctttaactcattgtgtttgttcagtgtcttctatcttgaagtagataatgatcggggcctttattgcaggtcttctcatatttttggatgagcttgtcacgtggaatatgtgttgagtaaacttatctaatttacaaaatgctagtatacgaaccatgataaaattcagataattcttatttaatctgcagtgatagaagaccctgggcatgtttgggatg

SEQ ID NO: 4373 - DNA, 297 bp, Zea mays
  misc_feature: Incyte ID No: 700348318H1
  unsure 2, 35, 48, 294: a, t, c, g, or other
gnggatagagttgtagcaacagcgagctgcaagtngcaacaactctancccaccctgaacgtcaaggacgtcattgatgtcatgcctgggcccatgaaatcttctgttgcacttctgaaccaagccgaccttggctggtattcttggaagcacggtgcttggaacaatctgcatcgactgctgtatgctcccaactggttgagctaacggccaatctcggctcactctgctgaggagatcatagcctgtaaatctttgattatgctattacttgtgtgtgtcgcacctggctgnaaa

SEQ ID NO: 4374 - DNA, 299 bp, Zea mays
  misc_feature: Incyte ID No: 700348319H1
agatctataaatgccggaagcacgtagaggaataagtctatgtcaccaccaacctattgaaggttgaagatattatgcccctaacctatccaaaatcatgtaaacaactgtctgtcacagtttgaggtggttttgtctatgtggcgtggtgacaccgtatgtctatgtggactttgacctggacaaacttgcttgtggcattccaactcaatttgtaactgcacatcactctagtagtctttctacttccatcagctttagggtccgtttggatttagatatattgcaccccaatccag

SEQ ID NO: 4375 - DNA, 301 bp, Zea mays
  misc_feature: Incyte ID No: 700348320H1
aggagacgaaagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaatcctcaagtaccccctcaccacagaatctgcaatgaagaagattgaagataacaac

SEQ ID NO: 4376 - DNA, 295 bp, Zea mays
  misc_feature: Incyte ID No: 700348324H1
  unsure 2, 203: a, t, c, g, or other
anagcttgggtttagtggaattgaagtggtaaccaccgcaagcattttcgctaaggaaccaaaccaaatggacatgtttctagcactgccagaaatctataagaaggattacatacttcagatgctcagtggtggacaatgtatccaatattcagccggttagtttgtattcagcatgataatggtcggctagatatttgtanacagtagtgaaatgtgtattcagtagtgaaatgtgtgaagattattttcacttccttcgatgtggtccttcccaagtgtaatgtgttttcga

SEQ ID NO: 4377 - DNA, 230 bp, Zea mays
  misc_feature: Incyte ID No: 700348325H1
  unsure 27, 32-33, 42, 46, 91, 155, 167, 184, 221, 226: a, t, c, g, or other
ctgggttagaggattgcagaagacgantgcgnngaaacgcanggancatgcctgtcgggtttttagcacagttcatttcactgggattttnaagcatttctgtctgaacacaaagcctgttctagtcctggcggaacacactgggggtgggggcnggggaagatgcngtaatgaaaccggttantcaattttgtcttaatattgttgacaattctgtaaanttccnatat

SEQ ID NO: 4378 - DNA, 298 bp, Zea mays
  misc_feature: Incyte ID No: 700348326H1
  unsure 66, 71, 208, 210-211, 234, 255, 257, 267, 269, 272, 274, 281, 285, 287-288,: a, t, c, g, or other
acgggacgagaaagcgaaaccctcacggcgccggaaccccaccagtcctccaccacctcccaattnccggncagcgaataaacgccactagattccggccgcggtccctcctccagcgccggcgtcccctcgattggctgcgaaccttgcggcttcgttcgcgcgatcgcagatctgggctggtttgtctagatagaggtgctctgtngnntaggagaaggtggggggcgtcanagtgccgggggtttaattttngncctttttaancngtnanggggggntttntnncccnccaagg

SEQ ID NO: 4379 - DNA, 296 bp, Zea mays
  misc_feature: Incyte ID No: 700348327H1
  unsure 233, 254, 259, 265, 273, 291, 294: a, t, c, g, or other
gctgtagcaaatcggactgatgcttgtttcatccgtgtaattggaagtgagttagttcagaagtatgtcggcgaaggtgctcggatggtcagggaacttttccagatggcccgctcaaagaaagcgtgcattgtattcttcgatgaagttgatgctattggtggtgctcgttttgatgatggggtgggtggcgacaatgaggtgcagcgtaccaatgttgggaaatagtaaanccagcttgatggggtttgtgncaacngggaanatccaagnttccatggccactaatangcntg

SEQ ID NO: 4380 - DNA, 123 bp, Zea mays
  misc_feature: Incyte ID No: 700348330H1
  unsure 56, 95, 99, 101-104, 109, 111, 113-114, 116, 118: a, t, c, g, or other
ggaacctttcccgcaggagaagggatacaaaagggcaccccgggatccgagggaanaccaaatgccatttcccatttcccaccaccaaacatcangganannnncaacngngnngngnaggag

SEQ ID NO: 4381 - DNA, 150 bp, Zea mays
  misc_feature: Incyte ID No: 700348332H1
  unsure 21: a, t, c, g, or other
ggagatggagagcccgcgcancccgaggcggagatcggccaccgggtggaggacctctgggaggtggcggagcgcagctctcgccgtcggagaagctcaactcctgcttcgaggacatccccgtacgcgtccttcccgcgcacgcacccg

SEQ ID NO: 4382 - DNA, 294 bp, Zea mays
  misc_feature: Incyte ID No: 700348333H1
  unsure 9, 130-152, 160, 182: a, t, c, g, or other
gcgacagcncgaactcgaatccctcatccagcctggcgctggcgtcgccggtcgccgccgctcgattgcctccgcctgaatatcccttgccccataaggcctgaccttgaaagcctcgcctcttgatccnnnnnnnnnnnnnnnnnnnnnnnatgccgangcggacgacacacacctactcnagcgaggacgcactgccggagggccccgagtccgaccttttcgtatactactgcaagcatgcgcctcacatgtctcatcaccgatacccaattgcagaaaatgcccaagcgg

SEQ ID NO: 4383 - DNA, 292 bp, Zea mays
  misc_feature: Incyte ID No: 700348334H1
  unsure 35, 54, 56, 59, 153, 180, 211-212, 229-230, 247, 252, 269, 271, 274-275,: a, t, c, g, or other
ttacaaaaccccaaaggttgatcctgaattgctcnaagagattgagcagtggancnaangcacttaagaatgatgtgatcaaattttgccaagagaacaattttcattctggtttctttgatggaactgaaaacaacatggtagctgatgccnctgaattgaaggtgcgtcttgaacacntcattgaaaggttagccttgatttctgatgnngcaaatacagaacgacnntctcttgtgtcaacatntgtcnaaaaggggggctctggngnganngnagnngancncnnaga

SEQ ID NO: 4384 - DNA, 294 bp, Zea mays
  misc_feature: Incyte ID No: 700348336H1
gttgaggattccagtgctgatgtatcagcagcagcagcaaacttccagagtttaagcctacataatgatgagttagctgcaaaaaagtctgcagaagataaacctgcagtgataattcctgaccacttgcaagttacaaatacagaatgtgtcaagttgagctttggcagttttggatctggtgcattttctgggttactcccacaaaataccactgatagcaatgtggaattccctgctcgagaggaatctgcaccagtagatcaaatagatgccaggaatcaagattactat

SEQ ID NO: 4385 - DNA, 287 bp, Zea mays
  misc_feature: Incyte ID No: 700348340H1
  unsure 39, 207, 225, 273: a, t, c, g, or other
cctgtccatgcaaagttgaaactgctgaaggagatagcngaggaacatgaagttgactgggatccatcagagacagagatagaatttctcaaacctcatgaagatctattgaatggcccgacctacttcaacggctccacactacctcttcccaaggagaaacacgaggaaacagtagcggcaagtgctgccgagcgggcctgacanagactgcgagtcagatancggtcttgactcactggatttcctgaagtccaaaagcagcatacgtcnaccttctaacaggg

SEQ ID NO: 4386 - DNA, 288 bp, Zea mays
  misc_feature: Incyte ID No: 700348341H1
  unsure 3-4, 11, 27, 32, 56, 61, 71, 75, 153, 162, 179, 187-189, 195, 211, 219,: a, t, c, g, or other
cannacacctnccgaactccgggatanaagtntcgcttctcgtcgcgacgactggncgagnccgacgccgncgcngccgcctgagttctttagaaatggctgatggtgaggacatccagcctcttgtctgcgacaatggcactggaatggtcnaggctggtnttggtggcgacgatgcnccaagggnnngttttncctaggattgttggcngtcctcgncacatggtnttatggtaaggntgggaccagaaggatncgtnggttggcgaagaggcanagtccaagagg

SEQ ID NO: 4387 - DNA, 266 bp, Zea mays
  misc_feature: Incyte ID No: 700348343H1
  unsure 24, 157: a, t, c, g, or other
atgatgtcgagggagcgcaagaangcggctgctcttcaacgagaagctgaagatcctcagctccatcactcactcccacgctctgagcaacacgtcgataatcatggacgcgtcggcgtacatcaaggagctgaagcagaaggtggtgaggctgaancaggagattgcgtgcgcgcaggacgcgctgagacacaaggcatcatcctatcccacggtgaccgtggaagccctaggagtgcaggggtcgtcgttcctggtgaacgtgt

SEQ ID NO: 4388 - DNA, 288 bp, Zea mays
  misc_feature: Incyte ID No: 700348344H1
  unsure 122, 166, 186, 191, 222, 226, 229, 236, 249-250, 268, 273: a, t, c, g, or other
cggaggggatggaccccgagaagcgcggctacgagctccaaaattttgtggcgcatgatgcggaagttaggtccctgtctattggcaaaaagtctaggcgtgtgttcatcaccggtggcaangatcgcaaggtccaaactgtgggccattggcaagcaaactccanttctgaccttgtccggccanacaantgcagtggaggctgtgcagtatgattcagcngagntgnttgttcntgctggctcatcnnatggttccagcgagctcnggganttgggtaaagttggg

SEQ ID NO: 4389 - DNA, 284 bp, Zea mays
  misc_feature: Incyte ID No: 700348345H1
  unsure 50, 56, 61, 96, 99, 119, 121, 135, 145, 148, 163, 247, 255, 260, 267, 271,: a, t, c, g, or other
gtccaggctccaggactaccaccactccgtctcgtctcgtcctcacaccncactcnaccancacctctgccttgcaaagctttccaccgatccgcngcntcgtccgcgcgctcgcaggnancagtgtggactacncgctccatantcnatcccctactcgaangatacaccgtgagtaggcgtgatggtgctgatatccgttttcgtgcagcttgttgctaattcgttttagtttgagggatcaganccacttgntctgnctgtctngctntntgggacaaggg

SEQ ID NO: 4390 - DNA, 307 bp, Zea mays
  misc_feature: Incyte ID No: 700348349H1
  unsure 242, 289-292: a, t, c, g, or other
gccgttgctaccgccccgtacctcgcttgctttcccgtcgccgaaatgacgaagcgcaccaagaaggctggaattgttggcaaatatggaaccaggtatggcgctagttgcgtaagaaatcaagaagatggaggtatctcagcactccaagtacttctgcgagttttgtgggaagtttgctgtgaagaggaaagcagttggaatttggggatgcaaggactgtgggaaggtcaaggctggcngtgcttacaccatgaacactgctagtgcagtcactgtcaggagcacnnnncgtcgcttgagagag

SEQ ID NO: 4391 - DNA, 306 bp, Zea mays
  misc_feature: Incyte ID No: 700348350H1
ggcaaccaacagccacagcctagcagaaaggttgaggagggagaagattagcgagaggatgaagctgctgcaggacctcgttcctggctgcagcaaagtcactgggaaggcggtgatgcttgacgagatcatcaactatgtccagtccctgcaaagacaagtcgagttcttatcaatgaagctcgcaacggtaaacccaaggctcgacctcaacatagaagggcttctatcgaaagatcttctccgcttccctggcgttccttcgtcttcccttggattctccccggaaatgatgcacccacagct

SEQ ID NO: 4392 - DNA, 305 bp, Zea mays
  misc_feature: Incyte ID No: 700348352H1
ggacagtgaagatgaaggctaccagcagaggacagtatctggcagaagaaggggagttattgcctccgaatcggagggatctgaagatagttactatgctgctggagctcaagaagacgaggaacctcgccaaacaaggaaacaaagctctccgttggaggaagaaagagatcatgaagtagttcgtgatgtgtttggtgatagcgatgaagatgaaccagctccatatcgtgttcgccatgaaatcgatgaagattctcataggtctcacatggaggatgaaggccattatgagaaggacatgc

SEQ ID NO: 4393 - DNA, 305 bp, Zea mays
  misc_feature: Incyte ID No: 700348353H1
cggggcagaaaaagactagcaactttgacgcctgccgcgacatcaacggtcgccgcctccgccacgtcaacgctgagcgccgcctcgaggaatggaaggccgaggccggggaccgccatctagaaaagctcgccgagaacttcatcaagaagaaggccaaggaggcgggccgccgcggcggaccctcagctgctgaggtggacaagtacctggagaagtaccgcaaggatgctgagatctgcgtcaacgcggttgaggaatccgtacgtgcatctcttggaaagaggaagaccgcccctaagccg

SEQ ID NO: 4394 - DNA, 303 bp, Zea mays
  misc_feature: Incyte ID No: 700348354H1
  unsure 243, 262, 274, 276-277, 299, 302: a, t, c, g, or other
gacacggaagccgccaagaacacggccaccaccggccccactttcgcctcccctctcttctctttctccaacctcggcggtgcttccttcggctctggctttggcttcaaatccagcgctcctctgccgcctgccatcgaggtccagctctgcgaggaatcacccgttccggcagctaggttggagccagtcgtggtcgatgactccttgacgatctacaagggcagagtgagtacatctgangtgtttggtgtcaaagatntgatttggtccntnnaaaatatgaaggtgggttgaanctng

SEQ ID NO: 4395 - DNA, 302 bp, Zea mays
  misc_feature: Incyte ID No: 700348355H1
  unsure 294: a, t, c, g, or other
acaaaccgcagcctgagcacccgaggagactccgtgcgaccgaagccagagccagcggaaccgaacggaagcgagacccccggcggctagcgagatggacggcggcgccggcgaggaggggaagcaggagcggcacctggtgctggcccacaagctcttccttctatcccacccctccgttgatgacctctccaaggtcgccctccgcgccgaagtcctcgacaccgtgaaatccgatgatatggcgacgctgtttgagtcgctgtcgccgggggtgtgctggagggggacgcngcgctgct

SEQ ID NO: 4396 - DNA, 302 bp, Zea mays
  misc_feature: Incyte ID No: 700348356H1
gtgtttcgctcccttctcgccctccgacggctggtgggctgccggcgccggcgccgccaaacgccaggtgctgaggccttcgccagtgtcttcgacggcgacgagcacgtaccagcaccaagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcagcgtcggggctaccctgacaccca

SEQ ID NO: 4397 - DNA, 300 bp, Zea mays
  misc_feature: Incyte ID No: 700348357H1
  unsure 4, 20, 27-28, 32, 68, 125, 129-130, 149, 169-170, 175, 181, 190, 202, 225,: a, t, c, g, or other
aganacagttccttccagantccatgnnagtnctgttctgagtccacagagaaaggcatcaccatcanctaatgatgaaactgcaaaggctgacactcctgctgcaccagcctcagattttctcnattnngctacaggaaatgccagtnatgtggtgggtgctgagatnncagancttggntttgcgaanccggtgcaagtngggtcttcggttgggcaggacgntgangcnncggtggcagnagngcagggtgggggtngacnagccgnggncnnagttgagagntggagttgtggtgg

SEQ ID NO: 4398 - DNA, 302 bp, Zea mays
  misc_feature: Incyte ID No: 700348359H1
  unsure 297: a, t, c, g, or other
gggatctgctccgtatttgcagggtgaagccttcgtgtctcctcgagggaaagtcactgacctttcttgggacgtggaccactgacggcccccgtcatcccccatgacggtgatcctagggtgaagccttcgtgtttcctcgagggaaatctaccagtgcgggattgatttagtcagcaccattggacacagggtttagttccattgcctggacccatcaatgaatcatggtgccaaggtcttgatggttcgacttcaaggtactgatattctccaggactattgttagcatccctngtggt

SEQ ID NO: 4399 - DNA, 107 bp, Zea mays
  misc_feature: Incyte ID No: 700348360H1
  unsure 85, 89, 91, 94-96, 98, 100, 102-104: a, t, c, g, or other
agctctgcagtctgcactctgcttagctccgagcttcagtgccttcgttgttagctgttagctccacagtccacagttccacacnacanangannncngnannnggg

SEQ ID NO: 4400 - DNA, 304 bp, Zea mays
  misc_feature: Incyte ID No: 700348362H1
  unsure 7, 153, 258, 272-273, 282, 295, 297, 303: a, t, c, g, or other
gccgcanccgcctcgccctctcggacggtcggaactcggtcgacgacgagacgacggtccctctcgcggttgtctcctagctgcctggcttgcaagcaacttgccagctgcccagctttgtctccagttccacttccacgcggctagctcctncatgggtcctggcttgcaagcactagcagtagcaggtgcagccgtgcagtgcggtgaccgccgaccggtgaggcatgaggccgtgccgtaactgcggaggactantagcagctgtgcanntgtgccggntgtgcctccacgntnaaatcna

SEQ ID NO: 4401 - DNA, 302 bp, Zea mays
  misc_feature: Incyte ID No: 700348363H1
  unsure 4, 14, 22, 26, 35, 84-85, 91, 93, 96, 114, 121, 134, 138, 148-150, 156,: a, t, c, g, or other
ctgntacacaagancctgagantganctgcaggangaaaccatgaagagcctgatccttcttgccatcctggccgccttagcgnnagtaantntgngttatgaatcacatgaangcatggnatcttatgaactnaatnccttcattannnggaganatgcaaatancttcatatcccctcagcagagatggagagctagagtccaagagnggntccgagagcgctctangcctgtccacgagctcaatngggnagnctgtgangactacagactttgcgaangtacgccatggtttntggnt

SEQ ID NO: 4402 - DNA, 307 bp, Zea mays
  misc_feature: Incyte ID No: 700348364H1
  unsure 9, 11, 28, 49, 57, 70-71, 77, 91, 107, 141, 149, 198, 202, 214, 219, 223,: a, t, c, g, or other
gccaacaananaggccaacgtgctgaanaggctcttgtctgatccttanttcaagantatagccagtgtnnataganagccttctgcacangctgtcacaaagcttnaatttgaattcgagaggcggagagttacaaaggnagacatangggagcttatatatagggaaattcttgagtatcatccaaagatgctganggantttcttgagggnactgngtcnagtngnntcatgtacccnngtgngtanntcattttaaatagcagttntnnatcntggcangatntnactccatggattctgggc

SEQ ID NO: 4403 - DNA, 304 bp, Zea mays
  misc_feature: Incyte ID No: 700348365H1
  unsure 132: a, t, c, g, or other
caactcttctcgccatttcaccaccgcctccgcccccatcctctccccctcccgtcgcgccagtcaacagcctgtctgcctcttccctcgccacccatggccaccgtagcgcgcaccctcgtcgccgcatgnccggcacgctctctcctccgcttccggtctcggcgcctcccgtcctcctcttccatccgtcccgcgcggcaacgtgccggcgtcgggtctgtccgctgcatggctcggcgaccggattcctcctattccccgctgcgttcggggcagggcggtgaccgtgcaccgactgaaa

SEQ ID NO: 4404 - DNA, 299 bp, Zea mays
  misc_feature: Incyte ID No: 700348366H1
aaattaatgataacctccatctcaaggatttggaattgcttggaacagccacaacagaacatattgtaagctctgttgatgagactagtccagaacgctctcatgatggcatggccggctatcatccaggagctgtcaatcctttggagcaacttggactgttcataaaggtagacgatgaggaagacgacgagcagtgttccctgcattaaagaaagaagagaaaggagaaatcagctgatggtgctgtgtttttccatgccctgtcacgggctaggggctggtgccaacctattgat

SEQ ID NO: 4405 - DNA, 301 bp, Zea mays
  misc_feature: Incyte ID No: 700348368H1
  unsure 12, 42: a, t, c, g, or other
ctcgtgtccgcngctacacgcgccgccggaaccctagcctcngccgccacaggcagccgggatggagaaaggagcctcggaggcgtcgcccccttgcgctcgctgcggcaagcccgctcagcttcaatgccccaagtgtgtcgaacttaagttaccgcgtgagaacgcagctttctgcacacaggattgttttagggcagcatggagctctcacaaatctgttcacccaaagcctggtgcaccggcatcccagcagtctccagaaggttggaaatattgtttgagaaaagggcgggaacgt

SEQ ID NO: 4406 - DNA, 302 bp, Zea mays
  misc_feature: Incyte ID No: 700348370H1
  unsure 113, 280, 299-300: a, t, c, g, or other
cccagagtagctttcttatcaagaacaaagtagtccttgatgttggtgctggaactggaattctttctcttttctgtgcaaaagcaggagctaaacatgtctatgcgattgantgttcccagatggcagacatggcacaggaaattgtaaaatcaaatggatattcagatgtcataactgtaataaaagggaaagtggaagaaatagaacttccagtcccaaaagtagatgtcatcatctcagagtggatgggctatttcctcctgttcgagaatatgtngaacactgtcctatatgcnngg

SEQ ID NO: 4407 - DNA, 295 bp, Zea mays
  misc_feature: Incyte ID No: 700348373H1
  unsure 77, 93, 130, 195, 202, 205, 244, 246, 256, 260, 277, 284, 286, 293: a, t, c, g, or other
gttattttttcatccttaaaattattgtccatgtttccctatttcaacttcttttttatggtagctctaactcatgncatttcttgatatganatatttaaaatttggttgaactaggggggtggttcanccattttgttatagactaacaattgtcaataactccatattgagataataagaaccacatatttnatttttngcncatcatgaatgaaacacatcatagggctacaaacaattncnataagtcatntggngaacagtataccgttgncctccangngagggcnta

SEQ ID NO: 4408 - DNA, 295 bp, Zea mays
  misc_feature: Incyte ID No: 700348374H1
  unsure 248, 260-261, 266: a, t, c, g, or other
tctggagggtttaaagttggcggagtacaaggtgtatttaaagaagaatggtcttagccaaactgggggcatggacacttgtgtagacagaatagtactccattggaggttcaaagatgcggatccaaggagaatttatcctcggtcatccttttgtatcaactgtaaaggtgatgtttgtaggggcgatgccgttctattcaaacagaagtgtccaagaagattggaaaaggcatgcaaaatgtatnggtaatcgtacnncagcnggcaaagtcatcaaggaaagttatggtaa

SEQ ID NO: 4409 - DNA, 281 bp, Zea mays
  misc_feature: Incyte ID No: 700348375H1
  unsure 3, 22, 39: a, t, c, g, or other
agngcaccactcgcatcgtgtnctccagtcagatcccantcccgcatttcctaaggaccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtg

SEQ ID NO: 4410 - DNA, 297 bp, Zea mays
  misc_feature: Incyte ID No: 700348376H1
  unsure 87, 90, 265: a, t, c, g, or other
gagaagtacctgcaagtttacaaaacctcactcagttaaccgttcttaatttgcaagataattctttctctggatccatccctgacntgnagcttcacagtctgaaactattaaatctgagcaacaatgaactgaaaggctcaattcctcgatctctccagaaatttccaaagggttcattttcagggaatcatggactgtgtgggctacctctagctgaatgctcacatccttcactagcacgctcacctgaatcatctccatngctcaatctccacctttgacacatcatgatag

SEQ ID NO: 4411 - DNA, 301 bp, Zea mays
  misc_feature: Incyte ID No: 700348377H1
  unsure 2, 18, 56, 79, 112, 130, 156, 170-171, 180-181, 190-191, 197-198, 204, 221,: a, t, c, g, or other
cncacctggaccatggancctggggaatgcacgtgtatgtctggagggatctgcantctgcggagacaattgcaaatgncacaacctgcagctgtaaaacctgtcgtaaaanctgctgcccctgctgtcncccaggctgtgccaagtgcgcccgangctgcatctgcaannggggctcanncaagtgcanntgctgnncctganacccacccatggcactnggananatcctgggaagggaccacgctgtacctgaganaanggattngattngtataataggtngngcntnnnatatgtg

SEQ ID NO: 4412 - DNA, 290 bp, Zea mays
  misc_feature: Incyte ID No: 700348378H1
  unsure 35, 56, 128-129, 177, 208, 249: a, t, c, g, or other
cgcttcactatccttcattccctcccctgtcagcnacgactgggtaggctaccgcngccgccctacgctaggtgcccatctcttcgccggcgaagagcgcccaccaagctccggccaagggcgtgatnncggctgtaggcagcttgaagccggggatggagactcttcatgtgcagnactacaaggacgcgcctccggccaaggccgnggtagagagcctccagccggcgatggagagtctgcatgtgnaggattacaaggacgggcttccggcaagggcgtggccgccg

SEQ ID NO: 4413 - DNA, 298 bp, Zea mays
  misc_feature: Incyte ID No: 700348379H1
ggggggataatgagaatgaaaagttatttagacagatcaccggccttggggagatttaggatcccagttgaagctgagaggctgagagataatgatcttgttcttgagcaatatctcttagctaattcacctggaatagctggattccggcttgattctttcagtgttataagacctcgtgtgacccattcaccttcttcatcagagttggacatgagggagttttcattgacacgaatggaagatagatttataaacccagcaattctgtatatacaggtcacagttgttaaggagc

SEQ ID NO: 4414 - DNA, 302 bp, Zea mays
  misc_feature: Incyte ID No: 700348380H1
caacatgccggtcgccagaagctgggtttgtcgcaaaacctatgtgaccccacggagacccttcgagaaatcgcgtctcgaccaggagctaaagttgattggagagtatgggctccggaacaaacgtgaggtgtggagggtcaaatttaccctggcgaagattcgtaaggctgcccgggagctgttgacgctggacgagaaggatcctcggcgtctgtttgaaggcaacgctctgctgagacgacttgttcgaatttggggtgctggatgagggcaagatgaagctggattacattctgggc

SEQ ID NO: 4415 - DNA, 170 bp, Zea mays
  misc_feature: Incyte ID No: 700348381H1
  unsure 21, 35, 37, 42-43, 55, 57, 99, 105, 108, 110, 128, 135, 146, 149, 152, 161,: a, t, c, g, or other
actacaggggggagacacatntctccccacctcgntncgcanntctccagccgcngnttcctccttcgacggcgtcgacgatgggtgactatggccacngcgggnggnanatgcggggcaacccggantcccgcnccaggggccanggnaancgcgctaangtcnagnag

SEQ ID NO: 4416 - DNA, 289 bp, Zea mays
  misc_feature: Incyte ID No: 700348383H1
  unsure 27, 119, 230, 275, 285: a, t, c, g, or other
ggtgcagcgcctcacgtaccggaagcntcacagctacgctacgaagtccaaccagacccgagtcgtcaagaccccaggcgggaagcttgtgtaccagtacaccaagaagagggcgagcnggcccaagtgccccgtcaccgggaagaaaatccaggggatccctcacttgaggcctgctgagtacaaaaggtccaggttgcctaggagccgcaggactgtgaaccgtcttntggtggagtatctctggaattgctgttagggggagatcattgtgntttctgggtngggg

SEQ ID NO: 4417 - DNA, 292 bp, Zea mays
  misc_feature: Incyte ID No: 700348384H1
  unsure 12, 257-258: a, t, c, g, or other
cgaaaccggaanactcttttcaacgttgatgatcatcagcacatagagaacggcaacctcggaaatatgaagcggtttcaattcagagagctccaggctgcaacagaaaacttcagcagcaagaacatattaggaaaaggcgggtttggtattgtttaccgggggcagcttccagatggaagtcttgtagccgtcaagaggctcaaagatggtaatgctgcaggcggggaagcacagtttcagactgaagtcgagannggccagcttagcagtgcacaggacctcctcagac

SEQ ID NO: 4418 - DNA, 295 bp, Zea mays
  misc_feature: Incyte ID No: 700348385H1
  unsure 3-4: a, t, c, g, or other
tgnnatacctatccatctacaaaggatgcagtaccttgcattctcatcattcttgggattgatagcgtgtctcttttggaatgtcatagcaactacaacagcatggattaaaggggaaggtgttatgatctggctgcttgccattatctacttcatatctggtgcgcctggggcttatgtgctatggtatcgacctctttataatgcaatgagaactgagagcgctttgaagtttgggtggtttttcctattttacatgattcatataatcttctgtgtgtgggcagctgtggct

SEQ ID NO: 4419 - DNA, 292 bp, Zea mays
  misc_feature: Incyte ID No: 700348386H1
  unsure 268: a, t, c, g, or other
ctattcatacaggatcacatgaaaattattgaagacgacggtccaggtgcagccttctatgccagtgctaaggccatgactaatggaaatcacactttctatgtgagcaaactgatacagaggttggctagattaagtaaatatgatacaatgtatcacatgcacaggtaatggtgaaatccaaaatctgggagagccgacttctattttctgcatgctggatataccataccttttccacctatatatacttcaaaactggtttttnagtgttccatttggttttgtgatc

SEQ ID NO: 4420 - DNA, 293 bp, Zea mays
  misc_feature: Incyte ID No: 700348387H1
ccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagaagtaatttgtgagggattggcaggaaag

SEQ ID NO: 4421 - DNA, 290 bp, Zea mays
  misc_feature: Incyte ID No: 700348393H1
  unsure 19, 32, 36, 40, 43, 45-46, 49, 94, 233, 279, 283: a, t, c, g, or other
acctccgccatcatgggtngcatgcacgctcncggnaagngcntnnacnagtccggcgctgccctaccgccgtagcgtgcccacgtggctgaanttgacgtctgacgacgtgaaggaacaaatttacaagttggccaagaaaggcctgactccttcccagataggtgtgattctgagggactcacatggtgtggcacaggtccgttttgtgaccggaaataaaatcttgagantcttaagtccaaaggccttgcccctgatcttcctgaggattctacnattngtcagaa

SEQ ID NO: 4422 - DNA, 291 bp, Zea mays
  misc_feature: Incyte ID No: 700348394H1
  unsure 200, 252: a, t, c, g, or other
gggttgccacttattcacagctatgacagcatccaagagttgaaccgcaaaatagaaaaacatgagcgaggccatgatcttgtagtatcatcttatgcacttggcgagattccttctttgagtgaccgaatcacaatagtgcgccagtttgggacctgacgagtgatgttttggttttgttagagcctgggacacctcanggagcaaagatcataagtcaaatgcgctcttatattctttggatggaaaaangaaagtgtcgcaaattgaaaaatcctcaagccgtcctcc

SEQ ID NO: 4423 - DNA, 297 bp, Zea mays
  misc_feature: Incyte ID No: 700348396H1
  unsure 195, 215, 243, 257, 264-265, 269, 280: a, t, c, g, or other
ctcatcacaagcagaagaaaatcgagataacgagagctagggttttgattccagtactcacgccgcatcctgtctccttctgcccctccctctcggcaccgcctccgccccctcattctctctcgcgtcatccggcggaggctcgaggaaactgaggccgggagcgccccgaagaatattctccacccagtcgcngacacccctgcgcgcgcganaatggtagggctggagaggtgccgatgnggtattgaaggggntttaganncatnatttttgtgtncaaaacgtggatggggg

SEQ ID NO: 4424 - DNA, 300 bp, Zea mays
  misc_feature: Incyte ID No: 700348402H1
  unsure 58, 278, 280, 288-290: a, t, c, g, or other
gcggttccacgtcgcgcttacggcgacggacgcactgtacagtcagtggcagtcgcgnataatgcactactggtataaggagatgagggaccgacctggttccgacatgggtggcttcactaggatccttcactcgggcaagcctgatggattgatggatgagatacccaccatggtggttgatccccttcctgaaggcaaggatcagggatatattgtcttaaataggccttgggcttttgtccagtggatccagaaagcaagatcgtagagagatntntaatggcnnncccgttttgt

SEQ ID NO: 4425 - DNA, 293 bp, Zea mays
  misc_feature: Incyte ID No: 700348403H1
  unsure 24: a, t, c, g, or other
ctctccgcacataccctccctacntcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggctgtgccgaaggtattgtctatggcaa

SEQ ID NO: 4426 - DNA, 208 bp, Zea mays
  misc_feature: Incyte ID No: 700348406H1
  unsure 33: a, t, c, g, or other
gcaatctggtcgcacagcaatactaagattgtnccggatggtatcccggctgattcatggttacaatgatgacctgatcactggagtgcaagctgtaggaagtaaacatcatccggatatgtaggtagtaggcattaacagtgttggttttgtttttgtttttgcatgtaggcttaagatgtttgaatgcataaagcagtccttttca

SEQ ID NO: 4427 - DNA, 274 bp, Zea mays
  misc_feature: Incyte ID No: 700348408H1
  unsure 9, 13, 28, 48, 57-59, 71, 101, 107, 113, 117, 120, 126, 128, 137-138, 146,: a, t, c, g, or other
caatcgagnatgnagtacgagcttgctnggccagaaatgtctctcttngaagcatcnnnaggagcggaagngaagcgatgaaggatggatccattacgaancctgcngatcgncatnccnttggangncacaaccanncatcgttngccataaggncnggcaaaaacatgccagtccgnggcgaggnnnggcngngcatcgacnatccactcggggancntaacctggcgcgcgaagcaccgacgcgcttcggagccgcggacctgnaggcggc

SEQ ID NO: 4428 - DNA, 303 bp, Zea mays
  misc_feature: Incyte ID No: 700348410H1
  unsure 9, 15-16, 22, 30, 40, 111, 149, 153, 178, 203, 240, 255, 261, 270, 286,: a, t, c, g, or other
aagtatctntatctnnatcccntcacgtgnacctgcagcnatgtccatatccagtgactagtcagcctcagtgcaccaacacctgctaccagacacagctcagcgattggnacacgggcctcaccgactgttgcaacgatatgcccgtntgtntgtgtggcactttcgctccactgtncctcgcctgccgcatctccgatgantttggggagtgctgttgtacgccatacctgcctggangactgcactctctgngcacangcatgcggnaacgtaccacatccanggctcngtngggcagac

SEQ ID NO: 4429 - DNA, 302 bp, Zea mays
  misc_feature: Incyte ID No: 700348412H1
gcattttgaatccatgcagaaagattttggcatacatcccactacagagcattatgcaagcattgttactatgcttggacagtctggctacattgtcgaggcttatgaattcgtggaacggatgcctgtggaaccaagcattgaggtatgggaaaatttgatgaacatgtgtcgacttaatggctttttagagcttggagatcgttgtgctcagatcatagagtgcttggattcttctaggctgaatgaacagtctaaaatgggtctgttccctgtcgatgtgtcagatcttgcaaaggaaa

SEQ ID NO: 4430 - DNA, 298 bp, Zea mays
  misc_feature: Incyte ID No: 700348418H1
  unsure 105, 154, 161, 293: a, t, c, g, or other
ccgcggtctgctcgttcgatctgtgcagcagatctgaggtcccgggcgaccgtgaagcagcttcaatcgtcggcatggcgctcgtattgcatagtggggctgganacaagaatgccttcaaagcacttattgctgcagaatacagtgggatcanggttganttgaccagggtttttgagatgggtgtcctcaaacaagacccctgagtttcttaagatgaaccccttgggaaggttcctgttctggagactctgatggccctgtttttgagagtaatgctatcgcgcgctatnttgcc

SEQ ID NO: 4431 - DNA, 298 bp, Zea mays
  misc_feature: Incyte ID No: 700348419H1
  unsure 7, 28, 71: a, t, c, g, or other
accagangctcttaggggactgcctctngcgcctcctatggttggcccacctgcttatccatactttcaancccagcctgaacctgaacctcagcctgatcctgagcctgatgcggaagaggaacgtgtcaagctgctcaagcagatagagttctacttcagcaaggagaacctatgctcagatgtgtacctgaggcagcagatggatggtcagggctgggttgatttatctcttatagctggcttcaaaaaggtccaagggctgaagaaggacctacaatatataaaagagacggtg

SEQ ID NO: 4432 - DNA, 296 bp, Zea mays
  misc_feature: Incyte ID No: 700348421H1
aagcattgcaaggagggcactgagagctctattttctggtcttctattggtggaaagcagagttatacaaatagaaatgctgcacctgatgttgttattagagagcctcatttgtataccttctctctgaggaatgggaagctggaggttactgaaattttcaatttttcacaagatgatctgttgaccgaagacatgatgatacttgatacacactgtgaggtttttgtttggatgggtcagtgtgtggagacaaaagaaaaacagaaagcattgacattggccagaaatacgta

SEQ ID NO: 4433 - DNA, 295 bp, Zea mays
  misc_feature: Incyte ID No: 700348422H1
  unsure 4, 27, 46, 223, 268: a, t, c, g, or other
ggancaaagccaacaaacagccgctcngccttcttccgcggctgcngccagcgcgaggtacctggctggcattttgcatttgaggtccatcattgaatggctgcaacgatgggttcaatatctgccaatggttcttaccaaacaaataggcccactgcactaaagcaggcacctcacatgcaattccaacaatgttgcaacggtggacttaggttcttaagcnagcattcccaatccacgcgaagtaagatacaggtggctagaagangagtacagataatggattcatccaaag

SEQ ID NO: 4434 - DNA, 301 bp, Zea mays
  misc_feature: Incyte ID No: 700348424H1
  unsure 221: a, t, c, g, or other
gggaccggaatgcccgcaacagccaccagtacacctgcaagcacaaggatccaacccctcagagcaccgagaacaagccgccgtcagcaccgccacagccacaagccttccagccggccttcagccaacccaaccaggcactgaacagtctggatttcagcctgcccatggacgggcagaggtccatcgccgagctgatgaacatgtacgacaacaatttngtgccgaacaagaacccgagcagcgacaggtcgccgtcatggagaggccaaacgcgatgccccagcagaggatccagatg

SEQ ID NO: 4435 - DNA, 297 bp, Zea mays
  misc_feature: Incyte ID No: 700348425H1
  unsure 67, 70: a, t, c, g, or other
tcgctgctgctcgagacctacatccgcgatggcaccgagaaggaccgcctcttccgcgccatcgaanccntccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctt

SEQ ID NO: 4436 - DNA, 299 bp, Zea mays
  misc_feature: Incyte ID No: 700348426H1
  unsure 34, 36-37, 40, 81, 104: a, t, c, g, or other
ccctctctcgtctctccagcgacggcagcgggcnanncgntacgcgaaggcgaacggagtagtggaagcagaggcggcagncatggccgtgatggagaagctcncagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaattgcattgttttctcat

SEQ ID NO: 4437 - DNA, 298 bp, Zea mays
  misc_feature: Incyte ID No: 700348427H1
  unsure 71, 185: a, t, c, g, or other
atctcacatgagatagaacttaataaacatggtcttttgccctcgcactgtcatttgagtggatcaaaganatgtgatgatcaaaccaaatcaactccaaattcagatatgggtcctttggattttgacatcaccaacaaaaggcagaagacttatgggaaacactcttgcatttttggagatgnaatgacacctatgaaatgcttgtccaagatacatcccttaccggctggacaggataatccatgcgatgttttacagcattgtcatcggggcccttcagatcctgcctctctta

SEQ ID NO: 4438 - DNA, 297 bp, Zea mays
  misc_feature: Incyte ID No: 700348428H1
  unsure 6, 40, 88, 111, 131, 283: a, t, c, g, or other
tcaggncggcgtccacggcgcggctgcacaagcgcaactnccgccgcttcgcgcagcacctcaagctcatcagcggcctgctggagangctccgcgtgtcggagctcaggnagtacccagagacgccgganccgctggagcagctcgaggacgcgctccgccgggctacagatgaagtgggaagttcatcattcgtgtcaatgagcaactaaatctacattcttatcctatcccaaatggtggtcaacatgatttgcttcccaacttgatgtgctatcttcanataccgatccagag

SEQ ID NO: 4439 - DNA, 301 bp, Zea mays
  misc_feature: Incyte ID No: 700348430H1
  unsure 78: a, t, c, g, or other
ggctccgtcgtcgcgtgccatcctagggtttctttccccgtcggcgcctccccagatttggccgccgccgccgctganccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaa

SEQ ID NO: 4440 - DNA, 303 bp, Zea mays
  misc_feature: Incyte ID No: 700348432H1
ccacttcccaaacccaaccggcggcgcacatcgctaccaccgtccaaagatggtgaagttcctcaagcccggcaaggccgttatcctcctccagggccggttcgccggccggaaggcgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagtcgtcaattcacgcacctcatgcccacccgctacac

SEQ ID NO: 4441 - DNA, 295 bp, Zea mays
  misc_feature: Incyte ID No: 700348433H1
gcagagttgctgattctatgcttgtgaatactgcacttatgttgatctatatcactaagttcttttggtgggaatctggatattggtgtactatggacattgctcatgatagagctggtttctatatctgctggggatgcttggtatgggttccatccatatatacttcccctggaatgtaccttgtaaaccaccctttgaatttgggcccccagctagcactctcaattctgctagctggaatgttgtgcatatacataaactatgattgtgaccgtcagcgccaagaatttcg

SEQ ID NO: 4442 - DNA, 292 bp, Zea mays
  misc_feature: Incyte ID No: 700348434H1
  unsure 24: a, t, c, g, or other
caaggggtcataatggtggaagantcatctttgatgattatcgtgaggcatactattggcttcgtcagaacacgcctcctgatgctaagattatgtcttggtgggactatggataccaaattacagctatgggtaacagaactgttattgttgataacaatacatggaataacacacacatagctacagttggacgagctatgtcatcttatgaagatgaagcatatgagatcatgcagtcacttgatgtgaactatgtgcttgttgtgtttggagtgtactggatatcctc

SEQ ID NO: 4443 - DNA, 294 bp, Zea mays
  misc_feature: Incyte ID No: 700348435H1
tcagagatgagtaccgtacagattatgatcctggaagaggtggttacggtaagatggttctgagggaactagaagcacagcgagaattagttgactatggtggatcttttcaaccgaatgcaccacctccctatgagagaagtgagcggaagagaggacatggagattctcataggaatgacagaggagattaccagcggaaacgctaccggaacgatgaccggtcagcaccagaggagtccaagagagcaccggactctgatccagcggagaagaatcctagattccgtgaga

SEQ ID NO: 4444 - DNA, 292 bp, Zea mays
  misc_feature: Incyte ID No: 700348436H1
  unsure 8: a, t, c, g, or other
ctgagcgnagagtggatgaagcactggatgcactggatgaagcagaacgggttgctgttgatgcaaaacgaaaacagactctaactgcagctgaagttttggctttgaaaagatcaatctctgataatcgtcagaggctggcagatcagcttgctgaagctgcttgtcagtcttccactcgtggtattgagcttcgagctgcggcttctgccctcaaaagacttggtgatggcccccgagctcacagcctcttactcagtgcacataatcaaaggcttcaatgcatatgcaa

SEQ ID NO: 4445 - DNA, 295 bp, Zea mays
  misc_feature: Incyte ID No: 700348437H1
  unsure 3, 25, 63, 85-87, 94, 97, 108, 114, 140, 168, 179, 182-183, 190, 192-193,: a, t, c, g, or other
aangatcgtactatctaactcatcncttgacattgtacttcatgatacatactacgtagtagnttcacttccactatgtattatnnnaggggancantattcgccatnatagcnggcttcgtccactgattcccactatnctcaggctataccctaaatgacattgancataagcccanttnnccattananntgtaggtgtanncatnannttntttcctcaacacttcctangattancatggatacctcgtcgttantctgattatccngatgcttataccacannnngtac

SEQ ID NO: 4446 - DNA, 286 bp, Zea mays
  misc_feature: Incyte ID No: 700348438H1
  unsure 240, 261, 273, 279, 282, 284: a, t, c, g, or other
cccttgcatacacatcttgaagattgagaaacacactccactcacttggaacatgtacttcatcacttaggtgagactagaacactcctagtgcatggtgtagtgttcatgcttcttgtggcactagttgagtgagttggaccgattctacacctattactcttgatgattgtcattacctagatggcccaatgattgtgggattgttgaaggttttggtgattcttgtcaactcagatnatcctgtgtggggtcttatgntatcgcgtgggngatctnagngnaa

SEQ ID NO: 4447 - DNA, 293 bp, Zea mays
  misc_feature: Incyte ID No: 700348441H1
  unsure 237, 243, 247, 256: a, t, c, g, or other
agcaagtcaaagccatgagtgtagctcctacaggatatgttccccatctccctcatccagcttcataccacccggctgcatttgctccatttgtgccgccacagcaagctgcaggcaacaaaagtgctccaatccctgcacctttccctgggatggcaatgtggcagtggctgcctccgaccatcgtggacacaactcaagacccaaagctctggccgcctaatgcttaggggcagntagctncctnggggtgtanactcgcaatcgccatgccgtttcatgcattgggcggc

SEQ ID NO: 4448 - DNA, 294 bp, Zea mays
  misc_feature: Incyte ID No: 700348442H1
accgaccagcgcatagagctatttgattcagatgcgcatttggcagaaggcaagcgctgagcgcgaaggagtaaaagcatgatcagatattcagatctttgatcagtctagactgacaccttaggtcgccctttacaaatatgacttaaaaaggatgtgaacagagtagtacagcacatgctttggaagtttggatattcttgtccgtgtaacttcccacatgaacaacgagcaaagcatctcctgcatatgcatcaattaatggcttaaagctattgagtgctgatactgagc

SEQ ID NO: 4449 - DNA, 293 bp, Zea mays
  misc_feature: Incyte ID No: 700348444H1
  unsure 143: a, t, c, g, or other
cacagtttgtataagatggcccaaaatttgacctcaagtgagcaggaggtaatgaaactcttcgacttatttcaaaattaccatgtgagaagaacagacaaattggatgtccaggaaacaaaaagggtgttgagagaattttntccaaattttatgaaggcattgaatgcaagtggtattaagatactgaatgacttggagaaggagataacccttgatgagatttgggacatgattggaagaatggccatggcgtacaataagaagaacagcatgccctcaaagattagccc

SEQ ID NO: 4450 - DNA, 294 bp, Zea mays
  misc_feature: Incyte ID No: 700348445H1
  unsure 261-262: a, t, c, g, or other
ggagtctcttctcatctttaaccactggactgtatctgactttcaagttgacttcggtttgaaaaggttcagtcattcttggccgcggtgaaagcactgtcacgtaaagatgtgcattatgggtcttatgcgactgcagaacaggtctctctacatgaacgatcctcgggagtcgcacctgagcatggtcaagcggattcttcggtacctctagggtattgtcgactacgggcttcatcttcagcactcctccacacatgnnctgattgtctacaccgatgttgactgggccgg

SEQ ID NO: 4451 - DNA, 289 bp, Zea mays
  misc_feature: Incyte ID No: 700348446H1
  unsure 35, 202: a, t, c, g, or other
tttcaaaaacatctgttgatggaaacactctacgngcaaagctggaagttaacaaatcacaccttgcagagccaagcacagaagttgaagcaatatattcatctacagaagttgacaaactgccacttccagggccaagcatggatatcgaagtaatggactcaactcttgaagttgacaaactgccccttccagagcgaanatggatgttaaagttgtgaattcgtctctgaaagttgacaaactgcactttgcagagccaatcacagaagctgaagtgatccactca

SEQ ID NO: 4452 - DNA, 296 bp, Zea mays
  misc_feature: Incyte ID No: 700348447H1
gcctgggtgtgttcagaacacatgtgctcacagggcttgcccgctgcatcttggttcagtgaacgagggtaggatccagtgcccttaccatggttgggagtactctactgatgggaaatgtgaaaaaatgccatcaacaaatatgctcaacgtgcacatccagtcattgccatgctttgagcaggaaggaatgggggtgcatggcctagggggaggatggcgactaggttcatcgatggcggcaagcagctcgtgttcgaccacgcgacacagttcttcaccgcgagcatccgcac

SEQ ID NO: 4453 - DNA, 294 bp, Zea mays
  misc_feature: Incyte ID No: 700348448H1
  unsure 43, 109, 190, 206, 214, 216, 235, 254, 290: a, t, c, g, or other
cttcgactcctttctggagcagctagggttccgtcctcgatcngatccgccgagtgcacaccacctttccccactccgatcgaatcgatggccgccgagggcgagaagnagatgataaccctcaaaagctccgatggcgaggagttcgaggtggaagaggcggtggcgatggagtcgcagaccatccgcnacatgatcgagatgantgcgcganangggattcctttccaaaggnatctccaagatcctatcgnggtaatcgagtatgcaacaagcacgtacatgcgcgnagcc

SEQ ID NO: 4454 - DNA, 299 bp, Zea mays
  misc_feature: Incyte ID No: 700348450H1
  unsure 251: a, t, c, g, or other
agaaagctcgacgatacatgaacaatatgaggaaaaagcctcgggttccctttactaaaaagtttccagggatagatcctatggctctccatttgcttgaacgtcttcttgcttttgatcctaaggaacgaccaagtgctgctgaggccctggcagatccatactttaatggattagcaaataatgaacgtgaacccatagcacaacctatctccaaaacttgaaatttgagttgagaagcggaaactggnccaagatgatgtccgagaattgattaccgagaggtactatgctccatt

SEQ ID NO: 4455 - DNA, 293 bp, Zea mays
  misc_feature: Incyte ID No: 700348451H1
  unsure 61, 194, 219, 255: a, t, c, g, or other
gttacaggtctggccgtgcgtccccatggtcaagccaggaccaccacatccacatggtcgncagccgcccagccaagaagcctaagaacacggggtactatgccgaaggtgtccgagagcatgctcggaagcaggaacgagagcagcagtgccatcaggcgtgagcaagaagaggtggtagagttgctgcagcncgtagaaaaggacggcgtgtctcanggatctgagctgttcttcatagctactgagctgttnaggtcgcgatccgacgcgcgcattaagtgcatcaccat

SEQ ID NO: 4456 - DNA, 294 bp, Zea mays
  misc_feature: Incyte ID No: 700348452H1
cgttacaagggcccgacggcggtgtcgtcgccatcctgcgcagagttgaaatatatccccacaataaagaagaaagaatcgcaagaacatggggtacaactgcacctggtttaccctatgttgatgaggctattgcgtcagtgggaactggctgatcggtggcgatctggaggtgttggaacccatcaaatacaatgatggtcttgatcatacagactttcacctcggcaacttaggaaggagtttgacaagcggggggctgatgctgtgtttgccttccagttgagaaaccca

SEQ ID NO: 4457 - DNA, 295 bp, Zea mays
  misc_feature: Incyte ID No: 700348454H1
  unsure 126: a, t, c, g, or other
agctccaggagctcaaagacgccatttctggtggatcaacacagagtatgaaagatgccatggctgctctgaaccaggaggtgatgcagattggccaggcaatgtataaccagcctggtgccagtnctgctgggcctactcctggtgctgaggccggacctacgcctggtaccggaccaacgcagaatgatggggatgtcattgacgcagacttcacagatagcaattgaggggtgattgatgcatggccatgtgttgagcaaggttggcgttaaggagtgaacaaattgttcct

SEQ ID NO: 4458 - DNA, 294 bp, Zea mays
  misc_feature: Incyte ID No: 700348455H1
  unsure 5, 101, 105-106, 113, 134, 141, 145, 155, 177, 181, 188, 191, 201, 206,: a, t, c, g, or other
gcgcncttctccctgtaaacctagctgctctacctacccgcacccccaccccgtggagagcaagtgcagccatggcggcggatcgggagaaggagcgcgangcgnngtggagngcgccatgtacactaactgcntactccncggnctcgatcccncggtcctcggctctccctcttncccngccggcngcntgggcctatntcgtnantccaacccccgccttgggaaggaaactctgctactnngttctctncncgctangggcancggncagtccatnaaagatttngacng

SEQ ID NO: 4459 - DNA, 292 bp, Zea mays
  misc_feature: Incyte ID No: 700348457H1
ataggtattgaagaagtcccagatatagggccactacatgctcatttaggttcaaggaatgatgaggctcaagagaagtgaaacttaaatctttgacagttttgaaatggttggggacttgaggtggcagtcatggtatcttctgcttgtcagcattcgttctgatccacatgcagtatatgcctttatgatatggcccccgcacagcattttctcttgaagcttcccgtctccgtagtcgcagctgaaagagagtggaacgccttgatttgtaggatttcttgtcatgctg

SEQ ID NO: 4460 - DNA, 289 bp, Zea mays
  misc_feature: Incyte ID No: 700348462H1
  unsure 43: a, t, c, g, or other
tctacgtttgcgaggaaattgtatccggtgtttctatgtcaantcggctggttcctccctttctgcattcctcgcccacctcctgacacccatctcatggttccgccaccaccttggacgccgatgtgtctggttcctcacgcttatccactggaggtaactgcttatcttggagacgcattatcgtcgatattagcactctatcaccaactacatgcctcagcttcttcactagttcacctcggcttattttcttgctcttaaactcttcatagcaaccaataatcag

SEQ ID NO: 4461 - DNA, 288 bp, Zea mays
  misc_feature: Incyte ID No: 700348463H1
gctggaccctctactcacttgccatggtaaatcctctcaactctggatgtcttccatttttttcttattaaagagttttcacctaatagttgattatgggttggtacatcaaggctgattcagttcaattttagcaacctttactgtttattaggtgcatttccaatattttgtgtttcggttagtaatttcttttgccagtttcatcaaacattgatcttctaaacaatttgtttgttttttgtgtgcctgccaaacttcttcatattaatgggttatgagattcaa

SEQ ID NO: 4462 - DNA, 290 bp, Zea mays
  misc_feature: Incyte ID No: 700348464H1
  unsure 72: a, t, c, g, or other
ccacgccaatcggagaagcgagccgtcgccgatcgattcaccaccgccggacccaatcacaagtaaacctgngccgggaaaccaaatccttctcaattccttcgcgacgcggaccgcaagccgaagggcggacgatgtccggagcggcggactaccaggagatggtggcgtcggtgccgccctcgctgaaggccatcacgctgacgcacgttcgctacagccggggcgacccgctgggtctcttcctcgcgtgggttccctcgtcccggttttatcagcttcggggtttg

SEQ ID NO: 4463 - DNA, 297 bp, Zea mays
  misc_feature: Incyte ID No: 700348465H1
gaagtttctggttcatcagcaaaggatgttgctaagcagctcaaggaacaacaaatggtgatgccaggacatcgtgagtacaaacttgcagaaggaactgaaaccgatacatccccactgctgctgcatttggtggagtatgcatcggcgcattgactgtcctggctgatttcatgggtgcaattggttcaggaactggaatactgctggctgtgacaatcatatatccatacttcgaaaccttcgagaaggaaagggcaacaagagcttggttcctttggtttttgataatagccg

SEQ ID NO: 4464 - DNA, 287 bp, Zea mays
  misc_feature: Incyte ID No: 700348467H1
  unsure 22, 50, 57, 113, 153-156, 233, 242, 244, 255, 275: a, t, c, g, or other
ctaaaccctacacatctctctnggccacggtaattgccatcgccatggcngggaggngcccggcaccggtggccatcctccttctcctcgccgcggcattcgcccccatctcntccgccgttcgcacagtctccgacgcgcacagatccgctnnnntggagcttttcgccccctccgtgacggatccttcggcgatttggagagtacgtatgaggcggtgaagactttcaagntattcgggntngagaattatangagtcgtctgggaagggtgnagtttgccgcgg

SEQ ID NO: 4465 - DNA, 222 bp, Zea mays
  misc_feature: Incyte ID No: 700348469H1
gctcactcaccttccttactactgctcactagtcactacacaccaaccaaaggaaggcccctcgcacctcttctgtggctgtcgtcgtttgcctttccgtccgttagccaagccatgggcaactggcctcaacacggcctccaagcggagtcaccggggcatgcttttgccggaggaggaagagagcctctcggagataagaaggataagccagctgcttcg

SEQ ID NO: 4466 - DNA, 289 bp, Zea mays
  misc_feature: Incyte ID No: 700348472H1
acttgatgcagagatgttgggaagctactccgactgatcgcccttcatttgaggagatcattcctgaactagaggatatccaggcacaagcacagagaacatcaggggaaacgagccagatcagaggaggaccactcatgcagtaaagattgattgaccccctctgtacatacatgttgacaattctctcatctgatcactaaaatgctgagaaagtagcatatcatcagttttgatgccatagaaaaaaagtagcgaatcattttgtcaagttttgtcagaacctttt

SEQ ID NO: 4467 - DNA, 280 bp, Zea mays
  misc_feature: Incyte ID No: 700348475H1
  unsure 36, 113-114, 124, 126, 134, 138, 243, 245, 266, 270: a, t, c, g, or other
attttgacacgcgtccatcacacaaatctggtgcgnttaattggttattgtgttgagagttgcttatttcttgtttatgaatttattgagaacggaaacctaagccagcattnncactctactngncccatganagangttcataacccgtcccatgcagatgctggcttaggttatgaacctctctcatggaccagtagagtgcaaattgcccttgattcagcaaggggtctagagtattcntnggcacactgttccagtgtatntgcntcgagatatc

SEQ ID NO: 4468 - DNA, 286 bp, Zea mays
  misc_feature: Incyte ID No: 700348476H1
  unsure 44: a, t, c, g, or other
agctgctgctcctggcctgctacgacctcacggccacctctgtncctgtcccactagactagctgcagctagcgcctctttccctcgccgccgccccctatccgagagcgacgagcatggcgcactccctcgccgcctccttctcgccggccgccgcgcggcgccaggtgacaaatgtgatttcaagccggagctcggtttccttccagagccacaggatgacttctgtatccatccgttcaagaccaagttctcttcggttcaagatttgctgttcggctaagaa

SEQ ID NO: 4469 - DNA, 279 bp, Zea mays
  misc_feature: Incyte ID No: 700348477H1
  unsure 276: a, t, c, g, or other
catgatgtttattcttgccgacaaatttgcttctctatttggttacattggatccctatggctcagattccttgccagagagaagcgtccatggacagtcgtcgacgatgtggaagttccgttttttgttgatgtgttttgtcgccagtgaagcgtgcatgaataccaaccattctgctttcccatgttctcttgcttatttgcatgtataaatcaactgtggggtgtgtgctgtgacttgtaagctgtcatccatctggcacacgcctggctgcntga

SEQ ID NO: 4470 - DNA, 269 bp, Zea mays
  misc_feature: Incyte ID No: 700348478H1
  unsure 50-51: a, t, c, g, or other
tccactcctaccccacacagaagcggcggcggcggagaaacgcaggcganngcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgactttggagggtccagtatgcatgagcaggatccgtaatgctgcaaggcattgtcacccttg

SEQ ID NO: 4471 - DNA, 281 bp, Zea mays
  misc_feature: Incyte ID No: 700348479H1
gtcaggatactgggaaatatgtctttggtgttgatgacactctgaaggctcttgaaatgggtgctgtcgagaccctgattgtgtgggaaaatctggatatcaacagatatgtgatcaagaacagtactactggggaaattattataaaacatctgaacaaagagcaggaagctgaccagagcaatttccgtgacccatctaccaatactgatctcgaagttcaggaaaaaatgtctctcctggaatggtttgccatgaatacaagaagtttggttgctcgc

SEQ ID NO: 4472 - DNA, 278 bp, Zea mays
  misc_feature: Incyte ID No: 700348480H1
  unsure 24, 34, 56, 61-87, 93, 117, 123-124, 148, 151-152, 158, 164, 166, 169, 182,: a, t, c, g, or other
acttcctctcaccagcagaccgcncccgccgcancgccaccgcttctccggatcanacggnnnnnnnnnnnnnnnnnnnnnnnnnnngtcaanggccgtccctgctgaggtgccgtncacttnntctccctgccgccgtagctcgcanaanncccatntggagntnttncttcttgccacancgtcgctaanaccgtncgnntgagaggaacgagcaatggantcttcgagagagatgggtttgtatgangtggtgttcggtancattgccggcnctc

SEQ ID NO: 4473 - DNA, 291 bp, Zea mays
  misc_feature: Incyte ID No: 700348481H1
  unsure 266: a, t, c, g, or other
gatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggaagactcctgatggccctgtttttgagaagtaatgcnaatcgcaacgctaatgttgctcgct

SEQ ID NO: 4474 - DNA, 284 bp, Zea mays
  misc_feature: Incyte ID No: 700348485H1
gattggcacacgctttcctttcctgcagacaagctgtaaatctcgcctagctcgtcgtcggagaccaaggagaagagcaagggggggcgcagaggcttgctggcttgctgcctacctagctcgtcggggccctatggagatccagcaccaccgggggctgggcaactccaaggttgtcaaggtgcagagcgaggaggcgtgggatctgttcaccgatcaagcgagcaacgaaggccggcccgttgttgcccatttcggggcgtcatggtgcgtgacgtcctgtc

SEQ ID NO: 4475 - DNA, 283 bp, Zea mays
  misc_feature: Incyte ID No: 700348486H1
gtggaagggtgcccttgatggaattggtggccatagttccaatgtttgtggaggactttggtgaagggcgcccttggtgtaatcttattgactgttgtagatgatgaagttgcaagttaatgtatttgagtacttcgactcacgtcagcttattgtttgtggcaaccatttccgcagaattcgagaagtggagttgaagcgtgactatgcattcattgaattcagtgacccccgtgatgctgatgatgcacagtacaacctagatggcagggacgtcgatgga

SEQ ID NO: 4476 - DNA, 282 bp, Zea mays
  misc_feature: Incyte ID No: 700348487H1
aattccagtgagtacgtaggaagagatccgcttcatgataaaccccgaattgattgtgggtatgctattcttgtcttgtatggaagataacgacggctatagaaatctttggtgcagaacggttctcacagtatatgggttatggttcctcctttcgctttgtcggtgactatttagataccaaaccctttgattcgatgggcagacggagaactaggattgtggctatcgatgctttggactgtccagctaggttacactacgaatctggctgtctcctaa

SEQ ID NO: 4477 - DNA, 273 bp, Zea mays
  misc_feature: Incyte ID No: 700348489H1
  unsure 12-13, 18, 21, 35, 37, 40, 46-47, 50, 190, 219, 225, 227: a, t, c, g, or other
attaaaagggcnntgttnggnttgtggctaaatgncnccnacccgnnccnaaggttagtcgttcgaattgaataactaaccttaggcaaaaaagttaggcaaagtgtggcaactgaggtaatgaaccaaacataccttaagactgactactctttatagatgaagcagcatcaagggacgcctgattgtnttaagcttggaggccgttgaaagtcctcntgagancngttcgtttattccaacttttagttttaatccctcttcacattctgg

SEQ ID NO: 4478 - DNA, 279 bp, Zea mays
  misc_feature: Incyte ID No: 700348491H1
  unsure 22-23, 25, 27-30, 36, 38-39, 41-42, 45, 49, 57, 72, 88, 91, 101, 105, 117,: a, t, c, g, or other
ccatcccctaactcaatcaacnnanannnnaaaaantnncnnacnctgnccgaggangagctgaatgacatnatccgtgtagctcatncanaccaagatgngaangtgaactatgangantttctgagagtcttcctcgagaagtgagaagtgagactgctggatncaanccccgcctcctcagctgcctgactctgacaggcactcgtgccttctancggggctctgcttttgtagtggggttaaaaaagaagtctgtgttngtgtgtgggaaactac

SEQ ID NO: 4479 - DNA, 281 bp, Zea mays
  misc_feature: Incyte ID No: 700348492H1
  unsure 73, 87: a, t, c, g, or other
agatttctcatcttttgaaagttgaacaagagcaaaacctaaagatgcaagaacgggatttaacaattcagtncactacagactaanctcaagtccattgagtctcagcttaatgaagccctcaatgctagcgatgctagatcaactattgggtctgaatctgcttcagtaatatcttccccaaagataacagaatcaactgctgactcatcttcagtgacgaaaaggctgaggaggaattggcaaaaagggatgcccttattgagaaattacatgaagag

SEQ ID NO: 4480 - DNA, 283 bp, Zea mays
  misc_feature: Incyte ID No: 700348496H1
  unsure 3, 17, 22, 25-26, 29, 36, 42-43, 48, 56, 66, 70, 78, 83, 96, 182, 184, 196,: a, t, c, g, or other
cgnagaattcacagttnaacangtnnggntcacagnttaatnntgtcncaatacanaaaatagtgntatnttatatcngatantaaagataatgtngattttgcggaaataacgaatgcccagcgtgtcgcacccattgtgcaagcagacgttctttgagggatgatcccaattatgatgcncngattgcagcccnatatccaganattganaagtatgaggnagaggaatttgcnttccgtgagtaggagaggttcnggataaaaagggggcccctctgctt

SEQ ID NO: 4481 - DNA, 301 bp, Zea mays
  misc_feature: Incyte ID No: 700348501H1
  unsure 85-105, 286: a, t, c, g, or other
ggcgtacgtacgtgaacacacatcgatctccatatatctgtctagttagctagctagctagtagacatatggtgggctcgcagtnnnnnnnnnnnnnnnnnnnnnttgttggtcgccggaagacgaggtggtacgctgtgaccggcggccgggggttcatggcgaggcacctggtggcggccttgctccgctccggtgagtggcgtgtccgggtcatgacctcgccctatctagccctcggccatggagagacagagggattctgagcgacgtctccgtgatggcngtgcgtctatgcctc

SEQ ID NO: 4482 - DNA, 209 bp, Zea mays
  misc_feature: Incyte ID No: 700348503H1
attttgtatagtttgcagctgcaaatgtgtatcttgtgattttggggggaggatgcttgtttaagtaacgctcactggataccttgtagcactactgtttcaagagcgctcgaatgattcagtaagggctttcggtttcatcagaatccatatggattggcgtggattggctgagtttcaatccgtagcaagtcaaaaaaaatttataa

SEQ ID NO: 4483 - DNA, 303 bp, Zea mays
  misc_feature: Incyte ID No: 700348504H1
  unsure 268: a, t, c, g, or other
gttacttgaatcaggttcccaggacagacaataccttggacaaattttgcagtactctctggataagctgcgaaaactgtcttctcctgtgaaggaacacgagatgaagaagagtcatgatacattgttgggagaattggtcgaagactctaaatccaattataaagatccaaattcatttgttctttgcgttatcaagggtttgcgcttcactatgggaggattacaggctctaaaaacagaagtttactagagcacgcatccaacnattggaaccattgattaaggatcaaggtggagtgg

SEQ ID NO: 4484 - DNA, 300 bp, Zea mays
  misc_feature: Incyte ID No: 700348505H1
  unsure 11, 18, 49, 116: a, t, c, g, or other
tctcttccgcngtctcgnctcctcacgccattaaaccccactccgcgcncgcggcggccggcggcgagccctcacccatccgagcaagccgaggaggaagcgagcgcgcgaacagnatcaggaggaggcatgggtaccctggggcgcgcgatcttcacggtgggcaagtggatccggggcacggggcaggccatggaccgcctcggatccaccatccagggcggcttccgcgttcgaggaacaggtttcaaggcatcgtacaatcatgaatattttgaagaagagccaaggatccataga

SEQ ID NO: 4485 - DNA, 296 bp, Zea mays
  misc_feature: Incyte ID No: 700348506H1
  unsure 281: a, t, c, g, or other
cacctcctcaacctccagcccaacctccagcccggaatcgagagcaatggcgctcgccaaggccaaggagatcgttgcctccgctcccctcgtcgtcttcagcaaaacttcctgtcctttctgcgtccgtgtgaagcagttgttcgagaagctcggagcaagctacaaggccattgagttggataaggaaagtgatggagctgagctccagaatgccctgaaggagtggactggacagaggatgtcccaaatgtcttcatcatgggaagcatattggcggngtgatgatactatgg

SEQ ID NO: 4486 - DNA, 297 bp, Zea mays
  misc_feature: Incyte ID No: 700348507H1
  unsure 293: a, t, c, g, or other
ggggtttagtgagctgcagaccaccgtgtacttgtacgagttgcacaacatcaactgggttgtcaaagcctgcggcggccgtgttgctcgctttattgccaccgaaaccaagggttatgctcttcgatagcgccaacttctacatgttgtccgcaaccaacaggattcttgtgtgtgattttccatcctcaagtatctcagtcatggagctccccaatggggtggagaacaagcccggtggttgcatcatgctttccaggggagatagttctggaatctttctgatctatgtnaaag

SEQ ID NO: 4487 - DNA, 293 bp, Zea mays
  misc_feature: Incyte ID No: 700348511H1
  unsure 41, 166, 176, 179, 181-182, 226, 237, 248, 255, 257, 262-264, 273, 276,: a, t, c, g, or other
cttcccggtgtggatgttgccaacgtcgagcgcctcaaccnactagaccttgcccccggtggccaccttgggcgctttgtgatctggacccagagcgcgttcaataagctcgaggaggtgtatgggagctatgacgccccgtcgcagaagaagaagggcttcgtgntgcccaggtncancnntggacatcttaggcctcggcagcacgaagcctaagatgtccaangctgactgggnaggatcatcancttctgnangaggnnnatttggggnacncnccanaaaaaaaaggg

SEQ ID NO: 4488 - DNA, 292 bp, Zea mays
  misc_feature: Incyte ID No: 700348512H1
  unsure 87, 207, 234, 290: a, t, c, g, or other
attcactgagcaccaacgtaacaactgagagcaagcaacatgaagaaaagaagcctaccaacatgaatgcatttgatataatatctnctatcaactggtttggacctctctggtttatttgaagaatctaacaagaagagagaatccaaattcacatctaccaacacaagctcgacaatcatatcgaagatccgaagatattgcaangaatttgcggttgaatttgacaaaagnggatggtggcttgttaaagatggacgctccaaggccggaaggaaggggtatggttntc

SEQ ID NO: 4489 - DNA, 198 bp, Zea mays
  misc_feature: Incyte ID No: 700348513H1
  unsure 2, 6, 65, 70, 74, 148, 160, 197: a, t, c, g, or other
gngaantgctagtgcttgtatctactatcttcatcaggtacttcgcgatcctactgaagtattcnccgcngccnctgccatggccaccctcaaccctttcgaactcctcggcgccgacgacaacgacgacccgtcgctgttgattgcngggcggcggtgntgctcagaaagccgaggcgaagaagtccgccgtggcnc

SEQ ID NO: 4490 - DNA, 280 bp, Zea mays
  misc_feature: Incyte ID No: 700348514H1
  unsure 7, 247: a, t, c, g, or other
atcagtnggtgttgaatgtacattccacaccatatcacccaagggacaggactatgtggagggtgaaaatgcttccaaagcatccacatctgaatcgaaacaaaaggaaattctcgaggttgtcgtcacggaagttcttggttatgggaagttttatgttagactgtgggtgcgacggtcgagtgattttaagggatgatgctttacagattggttcaaaaaaaagcatatgctctttcaggttctncagtccagtgtggatgactgcaggggttgtgct

SEQ ID NO: 4491 - DNA, 291 bp, Zea mays
  misc_feature: Incyte ID No: 700348515H1
  unsure 205: a, t, c, g, or other
cagcggtccaccaagcgaaccgggatcaaagatcattcatacctacattaaagataaacattacagtggaataacttttggggataagtcacgtgtaggtagaggaggaatgacagctaaagtgaaggctgcttttgtggcttcgaacagtggcacacctgttgttattacaagtggatttgcatctcagagcattgttagagtncctccaaggagagaagattggtactctcttccataaggatgcaagtctgtgggagccatccaaggatgttagtgctcgtgagatgg

SEQ ID NO: 4492 - DNA, 287 bp, Zea mays
  misc_feature: Incyte ID No: 700348516H1
  unsure 214, 246, 252, 257-258, 263, 267, 276, 283, 286: a, t, c, g, or other
gtcagttctggtactggtatcctctcttgtatttcatcagcctggccttctcgccaacagccttcattgggctcaactctgatttgaaagtgccaaagtttgaattcctgtcgcatgctaaaccgtctctctttgagtatcccaaaccgacaactcagcagactacaacttcaacagtgaagctgccagcagccattctgtcaacttatgcganggcaaaatctagggcaaagaaggacgcagaangcaaantaccnnggagngggnaaagaaggnttttttnccnc

SEQ ID NO: 4493 - DNA, 300 bp, Zea mays
  misc_feature: Incyte ID No: 700348517H1
  unsure 2, 13, 44-45, 109, 111, 127: a, t, c, g, or other
cnacctcgttccnctccgctgtctcgcctctcccttggttcctnngcggcgacgactgggcgagcgcctcctcccctccctcactccctccgtgagctcctcgccggcngncgcgccgccgcccgtngccacgtcttctccgctgacgtgggctcaccaggttcaaggcaatatctgtgttaatcttggggaccttcagtagattgctgagagttctccttgatacaggggaataaagatccaaataagtttttgacatgatctgtagccatactgcaatggctacgaagcttgtggttt

SEQ ID NO: 4494 - DNA, 299 bp, Zea mays
  misc_feature: Incyte ID No: 700348518H1
  unsure 64, 181, 267: a, t, c, g, or other
atcagctgctggtaattacaacattaaccagtcgcttcccaggtcttccgttggttgggctgtncaatggtgagcaaagtgttattcctagcattgctccaagatttgaactcgtgcagcctgttgaagagcctgtttccagctggacaagcagtggtgcacagcatgttggtactcagcncaagcacacaggtttaactttcccagatgttgtgtctgaaccactgtatctgcatcaatggttcaacgtttcagtagcactgatanttcgaaatttctcagtgaaccagaaatgctct

SEQ ID NO: 4495 - DNA, 294 bp, Zea mays
  misc_feature: Incyte ID No: 700348519H1
  unsure 67, 95, 283: a, t, c, g, or other
gggaacttgcggcaagagcacctcttgttgtctcaaccctgcaagctatcagcggactaggtgactncagctttcgagaagaaccttcgccagtnctttcctcttctcgctgggctcataagctgccagcatggttctagtgaagtacaggtggccctgagtgatatgttcagcacttgggttggcccactcgttctccagtcctgctgatgctgaacatcatgttatacatagtagtatacatcccatgtgttcctccttcctccattatgttatgttaacntttatcgctgg

SEQ ID NO: 4496 - DNA, 107 bp, Zea mays
  misc_feature: Incyte ID No: 700348520H1
  unsure 3, 31, 36, 42-43, 48, 64, 74, 76, 86: a, t, c, g, or other
ggngcagggaagctatctgtgccaccagacnagcantagcanncgctncactgccagccattanccgcagctancnaacaaatggncaccgtcctgagcagcccccg

SEQ ID NO: 4497 - DNA, 212 bp, Zea mays
  misc_feature: Incyte ID No: 700348521H1
  unsure 2, 8, 12, 16, 25, 32, 34-35, 38, 40, 54, 86, 141, 144, 151, 163, 168, 170,: a, t, c, g, or other
gnccagcncgcncggnaccaacacntgctccngnngcntntgctcgcactcgcnccctgctgcgttttgtgccatcgccatttgcnatttctttcgaggaaaaagggaagcaagcgcggaaatactccacagatactactncanctacagntccgatccggcnaccangnggnaaccaatatntngctcnctttntcttnctcngtatggtg

SEQ ID NO: 4498 - DNA, 291 bp, Zea mays
  misc_feature: Incyte ID No: 700348523H1
  unsure 267, 289-290: a, t, c, g, or other
ggcgcacaggacgacaagtgcctccccgtccagtacctcgaggcgatccggggcctccaggccgcggggttcgctcccgcccgcaccatccacatctcgcttgtccccgacgaggagatcggtggcgcggatgggttcgacaagttcgcccgatcggaggagttccgcgccctcaacatcgggtttatgctcgacgaggggcaggcgtcgccgacggacgtgttcaagattttctacgcggacaggctggtgtggaggctcgtcgtnaaggcggcgggggcgcaagggnnt

SEQ ID NO: 4499 - DNA, 287 bp, Zea mays
  misc_feature: Incyte ID No: 700348525H1
  unsure 266-267, 274: a, t, c, g, or other
cccttctggcgagcatgcagacaaggtagatgaaggtgacaacacatctggttctgtatcagactcgtctagtggccttcctgtgcctgaatctgaatcgggggttacagaaaacactggtgaaacctcagcagttgaggttgccaaccatcatgtgcctgaagcaagccacagagagaacattccaagagttagttcgtctcaccagaatcctgctgttgcgatccagaagccaaagcatgacaggctgttgaccttggccgttnngggctgnctcttgataaagg

SEQ ID NO: 4500 - DNA, 295 bp, Zea mays
  misc_feature: Incyte ID No: 700348526H1
  unsure 23, 47, 54, 102, 118, 184-185, 197, 202, 204, 206, 226, 233, 242, 244, 248,: a, t, c, g, or other
tagccttccacccttcatccacncgccgctcctcgagcacccccgtnccgcgcngcctccggcttccggcgagatgtcacgcttcggtcgatccggcccgcngccgccgatccgcganacgtactcactcctcgtcctcaacatcaccttccgcacaactgctgatgaccctcttccctctctnngacaagtacggnaagantncncgacatctacatcccaaggngatcgcnggattggtnantcgngcggnttcgcgttcgggnaggtacaagtaggaggacnaggcnaanna

SEQ ID NO: 4501 - DNA, 208 bp, Zea mays
  misc_feature: Incyte ID No: 700348527H1
  unsure 168, 186, 197-198, 201, 204, 206: a, t, c, g, or other
gaagatctcgctcgatccaaggaggtgagtacaagatggtgagctcctcgtcgccggtggtcaacgtgtacccgctcgccaactacacgttcggcaccaaggagcccaagatggagaaggacacctccgttcgccgaccgccttcgcccgtatgaaaggtccactacngaaaagaaggatgcgtanaattgttgaannacnctntngg

SEQ ID NO: 4502 - DNA, 145 bp, Zea mays
  misc_feature: Incyte ID No: 700348528H1
cagaaatctgtggcagtctagccccgttacagctcgaagcgagaagtgctttccaaccgagtactgcagcgtccacaagaaatgttgcttcatcgcctgaaagtagctttgactcaccaaatctccaccccttccgcacttcctc

SEQ ID NO: 4503 - DNA, 290 bp, Zea mays
  misc_feature: Incyte ID No: 700348529H1
  unsure 68, 77, 222-223, 252, 271, 281, 283, 285, 288: a, t, c, g, or other
aggagtccctggaacatctggagaccttcaagcgggagaacaaaaacctgcaggaggagatctccganttgactgangcagttgggttccagcggaaagactatccatgagctggagaaggtccgaaagcagctggaggccgagaagatggagctgcagtcagccctggaggaggccgaggcctccctggagcacgaggagggcaagatctcccggccccanntggaattcaaccagatcaaggcagatatngagccggaaacttggcaanaagaagttangnanagntg

SEQ ID NO: 4504 - DNA, 285 bp, Zea mays
  misc_feature: Incyte ID No: 700348531H1
  unsure 210: a, t, c, g, or other
gaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagtncagccacaagtctgtgatgcgcaaggagttccgcaagatggccaaggctgtgaaaaaccaggttagtgacaatac

SEQ ID NO: 4505 - DNA, 290 bp, Zea mays
  misc_feature: Incyte ID No: 700348534H1
  unsure 51: a, t, c, g, or other
tacaaggttgctagtcatccgaatatatacgtgttggacactcctggtgtnctttcgccgagatttgcagatgatggttctggccccaggctagccttgacaggagctatcaaggactccttgttggaggattacgatactgtacagttccttcttgcgattgtgaactcagggaaggaatataggaagtgggagaagctgaataaagcaggagatacctttcttgtggcaacacagtcacgtccaggggccacaacagtaaagagcatatgcttcagatcacactcagg

SEQ ID NO: 4506 - DNA, 287 bp, Zea mays
  misc_feature: Incyte ID No: 700348535H1
  unsure 257: a, t, c, g, or other
cgagctttccttcggaactcagaactctcgtgctcacctcatccgttcgacaaatccacacgaatcctctgattcagagcagggtgttggcattgatcagacgcctgccatggcggatcagttcgtggattcggcgaacaatgtgatcatgaggaggtgaacaagggcctgaacccaggaatggtggttctgcttgtggttgcaagcttcctgctgctcttcttgtggggaattatgcgatgtatgtgtatgcgccnaagacgtcccgccaaagaagaagaagccgg

SEQ ID NO: 4507 - DNA, 285 bp, Zea mays
  misc_feature: Incyte ID No: 700348537H1
  unsure 7, 58, 77, 89, 111, 122, 129-130, 132, 137, 171, 175, 202, 205-206, 230,: a, t, c, g, or other
gcttttntcgcactcgtactccctcctcccctccggctaggaggctgctccctccgcngctcccgccttcgtcgcgnggccatcgtttncggctctgtccccggatatctnttcgccaccgntcctganncngcggngcgccacaaccgaaggcgaacccagtcgagtcgncttncaacactatggtgactctcccactgtngannaggaggacgaggagatgctcgtgnccccgcnagaggggtagaaanngacgnacgcanccatggaagttgtncaaagatg

SEQ ID NO: 4508 - DNA, 283 bp, Zea mays
  misc_feature: Incyte ID No: 700348539H1
  unsure 207, 216, 248, 256: a, t, c, g, or other
ggccaggccaagcaggaggtggaacataagaagaagaagctggaggcgcaggtgcaggagctgcagtccaagtgcagcgatggggagcgggcccgggcggactcaatgacaaagtccacaagctgcagaatgaagttgagagcgtcacagggatgcttaacgaggccgaggggaaggccttaagctggccaaggactggcgtccctnattcccagntccaggacaacccaggagctgcttcaaggaanaacccggnaaagctcaacgtgtctacgaagctgcc

SEQ ID NO: 4509 - DNA, 283 bp, Zea mays
  misc_feature: Incyte ID No: 700348541H1
  unsure 44, 211, 220, 223, 230, 235-237, 240, 242, 245, 249, 257, 275-276, 282: a, t, c, g, or other
attacagttaggttttatttggtcttagatttctatggttagtntttcatatgatgtttggccattccctacacagctagtcgttctttcatcaggcttgttctatagagcttgctagcctttttctaaagtgcagatttatatatattctcattgtgttgtgtgctgcctatgcataatattttttaaaaggagctaactgagtatagtngttgtaccnacnaataaancatgnnnaangnccnaggngtcacttntgtaacagggaggaaaanngggggnc

SEQ ID NO: 4510 - DNA, 208 bp, Zea mays
  misc_feature: Incyte ID No: 700348543H1
  unsure 135, 149, 170, 178, 185, 192, 199-200, 204: a, t, c, g, or other
gatgtgtgtttgatcagtgactggctgctctgctccatagaagatgaatgaagagagagatggtgaagaaggcttggcaaatggcaattgccgcagcaagccatgtcggcgccactgaccggcttagtgattggnatatttggtgtggnagcagccaggattaatgcgcnggtctttnatcctanaaaacanttgcccnngccnaaaa

SEQ ID NO: 4511 - DNA, 281 bp, Zea mays
  misc_feature: Incyte ID No: 700348544H1
  unsure 230, 237, 242, 257, 259-260, 262, 278: a, t, c, g, or other
ttcagaatggcttctagcaagctctttgcggttggcctcaccgtcttactaagcattattggactgtgcaatgctattagggtggtaaaccacgccaccgcagatggacaaggcggtggaggtggtggaggcggcgggagcggaaccagctatggctccggatccggctccggctacggcgatgccgaggcctatgacggcagtggcccagtccccaactctggccacgnatatggnagtgnatccggggaaggtgntnntntttggcaaggtgacgnacg

SEQ ID NO: 4512 - DNA, 280 bp, Zea mays
  misc_feature: Incyte ID No: 700348546H1
  unsure 5, 20, 105, 190, 253: a, t, c, g, or other
taaancaatctaccggagcnttttccccatgatcttgttgagaagttagaagaatacctggataaacttgaagggcaactcgtggacttgtcttccttattgtantgaccaccggctggtcgatgcatatcaaaacagtaccgatatcctgcaaagcactatttttacacaacagtatgtggaacgtgtncttagccaacgagagagacaagatgaaatgctgtagcatgaatatagttcatccaaagcagtncatcccaggctttgtctatggagggac

SEQ ID NO: 4513 - DNA, 281 bp, Zea mays
  misc_feature: Incyte ID No: 700348548H1
  unsure 154-179, 262: a, t, c, g, or other
cttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcaggtgaagaagnnnnnnnnnnnnnnnnnnnnnnnnnncagtgttagcggaagcggaggcgggcaacctgaatccctgggagtgctcgcccaagtgcgggtcgcggtgctccaagacgcantacaggaaggcctgcctca

SEQ ID NO: 4514 - DNA, 300 bp, Zea mays
  misc_feature: Incyte ID No: 700348549H1
cttgtctccgtttgctggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgattaccgccacaactatggccactacacgtctggatggactggatgtttggtacgctccgtgagccagatgatatctcaagaaggc

SEQ ID NO: 4515 - DNA, 301 bp, Zea mays
  misc_feature: Incyte ID No: 700348550H1
  unsure 152: a, t, c, g, or other
cgaggagctctgccggacccgcgcgctcgccgccttccacctcgaccccgcccgctggggcgttcaacgtgcagccctactcggggtcccccgccaatttcgcggcatacacggggctgctccagccgaacgacaggatcatggggctcganctgccgtccgggggccacctcacccacgggtactacacggcgagtggcaagaagatttctgcaacctccatctacttccagagctgccgtataaggtgagctccgacacgggtacgtcgactacgataagtggaaggaaaaggccatgg

SEQ ID NO: 4516 - DNA, 292 bp, Zea mays
  misc_feature: Incyte ID No: 700348551H1
  unsure 39: a, t, c, g, or other
ctgtcattctcaaggcatcatgcatcgagatgtcaagcnccataatgtaatgatagatcatgagcttcgaaaacttcggttgatagactggggcttagctgagttctaccatccaggcaaggaatacaatgtccgtgttgcatcgaggtatttcaagggacctgaactcctgttgatttacaagactatgattatcttagacagtggagtcttggttgcatgtttgctggaatgatatttcgcaaggaaccattcttttatggccagacaaccatgaccaacttgtgaagat

SEQ ID NO: 4517 - DNA, 295 bp, Zea mays
  misc_feature: Incyte ID No: 700348553H1
  unsure 93, 155-156: a, t, c, g, or other
ctatttgcggaaaggaacttctgttagtgctggccaaacatcaagttcatcaaatggaacaactgcaggagaaaggcctctcctacgtgaganattgtcaaagggaaaggatggctttgttgctgctgatttcacagctacagaagctcgttgtnntgtaccctcgactccaatactttggttccagcaggcagatgagtgcatgcacctatgcatttatcagcacaaaagtctcactatcttactgctggttcctgcttcctcagtgataatggagaagagggcattactcatg

SEQ ID NO: 4518 - DNA, 292 bp, Zea mays
  misc_feature: Incyte ID No: 700348555H1
  unsure 75, 283, 285: a, t, c, g, or other
atcgctccctgcctctggtcacctcgcttccgctcccggctcccctccggccacccagacatcgtccgttcgctncgccaagagacaggaccggagaccatggcggaccagctcaccgacgaccagatcgccgagttcaaggaggccttcagcctcttcgacaaggacggcgacggttgcatcacaaccaaggagtcggaatgtcatgcgatcatgggtcagaacccaaccgaggctgagctccaggacatgatcaacgaggtcgatgcggacggcaacggancntcgattc

SEQ ID NO: 4519 - DNA, 294 bp, Zea mays
  misc_feature: Incyte ID No: 700348559H1
  unsure 64, 173, 293: a, t, c, g, or other
ggcaaaacggatccgtaacttcgggaaaaggaagaggacaaggagatgactctggaggaatttnagaaaataagagaggagaagaggaaagcactacttgcattgaaggctgaggagaggaaagttgaagttgacaaggatttgcagtctctgcagccactttcaaacaaganagaaaatgatgaagttttcattaagctgggttctgacaaggataagaagaaggaaaatgctgagcgtgatgagcgtgccaagaagtcggtgagctcaacgagttcctgaaacctgctgang

SEQ ID NO: 4520 - DNA, 289 bp, Zea mays
  misc_feature: Incyte ID No: 700348562H1
  unsure 79, 275: a, t, c, g, or other
atggttcaaaagtttccctattccttggatgtatcatatgcatcggggatgtcatattgaagaatcagtataataaatncattttactagggaacatttaaaagaattgacggttgaggatcattttaaatgttccctagtaaaatgatttattcttgatggttcaaaagtttccctattcctggatgtatcatatgcatcggggatgtcatattgaagaatcagtataataatatggactattggagtggtcttaatgagctggagttggtgcntaaggcgcaacacc

SEQ ID NO: 4521 - DNA, 298 bp, Zea mays
  misc_feature: Incyte ID No: 700348564H1
  unsure 19: a, t, c, g, or other
cctttccgtgccactggtnaatagggattaatgaatgggaagagttcagtcagaccagtaagcccttctgggtttgagtgtgttcccatgtaggaggtaaaaccaattctggatgcatctaagcttccatgaataactttaattcttagcataatgatggccttggattgtctgacctcagtagctattaaataacatcgagtaacatctgcatcaggccctcatagaacattcagttgagttgggagtaaactgaaaagacaatgtgttgaaggatatgccagggatctggctaaaa

SEQ ID NO: 4522 - DNA, 295 bp, Zea mays
  misc_feature: Incyte ID No: 700348565H1
  unsure 159, 258, 263: a, t, c, g, or other
ccggcttcaacgtggatgcggtcgccaagtacaccgagaagcagatggcgtcgctgagcgccgactacgggctggatttgggcaccgtcagaggaaccgtcaacaacgcctgccggattatcgaggtaccgtgacccgtacgtgagcttcaccccagtncgttgaaagatactagtagcagcagcagtagtagttccagtaccatcctgcaacggaaagacgaagggaggcggtcatgaatggagaagaagatatatntaaanaaaaatcatctgatggcgttgttcttctccgg

SEQ ID NO: 4523 - DNA, 295 bp, Zea mays
  misc_feature: Incyte ID No: 700348566H1
  unsure 3, 32-33, 40, 86, 128, 156, 184, 248, 286: a, t, c, g, or other
aanatcccccctgcgcctcggattcgctcgcnnccccgcncgccgacgcaacagcgaggtcgttccgttccaggctttcggacggnggcggggtgacgtaaggaggtgcgcgggaggatccgttcgcncccggaggaccgggatccggcgcccgtngtcgtcgacgcccatgtcgggccacctngatcgcttcgcgcggccatgttttgaagggtgctcaagtcacgatgaacgtagagaccataatnagactttgaatctctgaagatgaaaagaagacaagatnaagctcttt

SEQ ID NO: 4524 - DNA, 294 bp, Zea mays
  misc_feature: Incyte ID No: 700348567H1
  unsure 7, 9, 28, 37, 51, 73-74, 76, 78-79, 92, 97, 120-121, 124, 130, 157, 160,: a, t, c, g, or other
ctgcacnantaccgcctcctccgcgtcncccctctcntcgcatcttgcggngaccggcggcggatcgtccgcnncncnngcgcagacaatgnggctnttcaccgtgacgaagaaggccannacncccttngaaggccagaagcccggtacctccggnctncgcaagaaggttactnnnttccagnagcctcattatctgcagaactttgtccagtgcaacattcaatgcncttcctggcagaccagtaaaaggtgcaaccattgttgtctctggtgatggcngntatnnctnaa

SEQ ID NO: 4525 - DNA, 286 bp, Zea mays
  misc_feature: Incyte ID No: 700348569H1
  unsure 2, 6, 8-9, 13, 15, 20, 35, 45, 60, 72, 75-76, 78, 84, 90, 98-99, 104-105,: a, t, c, g, or other
gncatngnnacantngtaanatctgcagtctgcantgctgcttantccgagcttcagtgncttacgttgttngcnntnagctcnacagtncacagttnnacacnncatatnatcngccgggccgaagaagagcttgagaacaagaagatggccctgatgatgtcatggtggagagggtgaagataaggaacaggaaaagancaagcgtgannnnaaacaacaantatatgacgaagtatgaacgtgcgcgcttcttggtacacgagcttgcagataagcnggntgt

SEQ ID NO: 4526 - DNA, 288 bp, Zea mays
  misc_feature: Incyte ID No: 700348570H1
  unsure 9, 57, 177, 249: a, t, c, g, or other
atccgaganacctcacaagccgccacgccaggtccccatcccatcgaggcgcctgcnccacccccgccctgctcccgcccggtagtagtagcagagcctccgccgccgctgccgagaatagatggggttcgtgtccttcgtcgggcgggtgctcttcgtcgccgctttcctcctctncgcctaccaggagtttaatgaatttggcgctgatggtgggccagcagctaaggcccttcagcccaagttcangtgtttgtaaaaaatatctctgcacatctgggagtagtg

SEQ ID NO: 4527 - DNA, 285 bp, Zea mays
  misc_feature: Incyte ID No: 700348571H1
  unsure 15, 25, 41, 50, 67, 72-73, 108, 154, 174, 231, 280: a, t, c, g, or other
ggcaggacgacgaancggaagaggngctgtacggggtgaangaagaggantgggctcagatacaagnaccanncaagaatccggcattccgtgccaccccagaatgcnacaaacagcggtaccggacggacgctgctgttcttttgcatggtangaaggggtcgaaacagcggncggcctcacttgacctcggtagccctgggttccaggagccacgttttctccactttncgtgattggtggtgtggggttgatgaacaaaggattggagctgcatcancagtc

SEQ ID NO: 4528 - DNA, 284 bp, Zea mays
  misc_feature: Incyte ID No: 700348575H1
  unsure 274: a, t, c, g, or other
tgttcatcatggacaactgcgaagagctgatccctgagtggctgagcttcgttaagggtattgttgactgctgaggaccttcccctcaatatctctcgtgagactcttcagcagaacaagatcctgaaggtgatcaggaagaaccttgtgaagaagtgtgttgagctctcttgagattgctgagaacaaggaggactacaacaagttttacgaggcttctccaagaacctcaagctggcatccatgaggatcgcagaacaggaccaagatcgcngagctctgag

SEQ ID NO: 4529 - DNA, 294 bp, Zea mays
  misc_feature: Incyte ID No: 700348579H1
  unsure 182: a, t, c, g, or other
ggcacgtggtagggattcatctacagagcttctcttgaaatctcagctggagtatgcccgggggaattataggaaagctgtgaagctattgagcacaccacataatcgggctgaaccagcaatgctagccattttctacaacaacctgggctgtatactccaccgacagagatcgtatcacncctctatatggtgctttagcaaagcgctgaaatacactttatcacttcgttcagagaaaccatgaagctgtctacattatcacaagacaagtcttgccttatttcatacaac

SEQ ID NO: 4530 - DNA, 296 bp, Zea mays
  misc_feature: Incyte ID No: 700348580H1
gatgccacctccgaagatgaggatgacagcggaggcgaggaagaggaggaagaggaagatcacgaaaacacgctgtgtggttcttgtggtgacaactacggacaggatgagttctggatatgctgcgatgcgtgcgagacttggttccatggcaagtgtgtcaagatcactcctgccaaggccgaacacatcaagcactacaagtgtccgaactgcagcggtagtggcaagagagcccgagcatgatgatgctggatatatccatctctcatgcctgacttgatgtaaaacaccca

SEQ ID NO: 4531 - DNA, 283 bp, Zea mays
  misc_feature: Incyte ID No: 700348581H1
ggaaaatgtctcgaacaatatcaaattcagtaatgtgtatgtgaagaatctgtccgatactgttactgatgatgagttgaaggagatgtttggaaaatatggaaccataacaagtgctgttgttatgcgggatagtgatggaaattctaggtgttttggatttgtcaattttgaaaatgcagatgctgctgctcaggctgttcaagagttgaatggcaagatttcatgataaggaacgtagttggaagagcacaaagaatctgaaagagagatggagttgagg

SEQ ID NO: 4532 - DNA, 285 bp, Zea mays
  misc_feature: Incyte ID No: 700348584H1
  unsure 106: a, t, c, g, or other
gcagtcagcacgtctccgtccccgacgatgccggggagcaatgccaatggagggcgcacttgtaacggacacggccgaccggccatcttcatccccctctccttgncgccctcggttccggactctgctcccctgccccatacccccaccgctcctcacgcctcgcctgactgccaaggcaatcccggaagctcctcccgcgcgcgaacatgatttggcctgcaacaacgcagaggaggtgatcttatgtaatacaaaagatagtaatggggatatccaaggtga

SEQ ID NO: 4533 - DNA, 279 bp, Zea mays
  misc_feature: Incyte ID No: 700348587H1
  unsure 59, 154: a, t, c, g, or other
ggtgcactggttctccattctcaactccctattcatcgagctcttcttcatcatgtcangcatatggatgggtcgtgtgtactatgtctttgggttcctcttcgtcgtcttgctgctcctggttattgtctgtgctgaagtttccctggttctnacttacatgcacctgtgtgttgaggattggaagtggtggtggaagtcattcttctcatctggatcggtggcaatctacatttcttgtactccatcaactatctattttgacctcaaaagcctgag

SEQ ID NO: 4534 - DNA, 281 bp, Zea mays
  misc_feature: Incyte ID No: 700348588H1
  unsure 7-8, 217-219: a, t, c, g, or other
ccgcganntcgccatgatctcgccggagaggagttcgtcacagagcccgcggtcgcaggcggtggcgggggcgccattcctgtggatatctgtcatggatcccgtcaagatgggcaccggcgtgcaggcctacatctcctaccgcgtcatcaccaagaccaacctccctgaatttgagggaccagagaaaattgttattcgacgctatagtgatttnnnatggttgcatgatcggcttgctgagaggtacaaaggcgttttatactccccttccggagaag

SEQ ID NO: 4535 - DNA, 277 bp, Zea mays
  misc_feature: Incyte ID No: 700348590H1
  unsure 229: a, t, c, g, or other
gtggatacaagcatggtggagggtatggaaacaaccagccaggatacggtggcggaggaaacagccaacctggatacggcggcggaggaaacagtcagcccggatacggtggaggatacaagcgccatcaccctggtggcggctacgggtctggacaaggagggcctggatgtggatgtggaggagggtatggaggtggcaatggtagtcctgggtacggcgatgacanggtggtggcatggcatggtggcggaaatggcatgctggtgggtacgag

SEQ ID NO: 4536 - DNA, 272 bp, Zea mays
  misc_feature: Incyte ID No: 700348591H1
  unsure 256: a, t, c, g, or other
ccccgttccattacaacaaaagatcgtgctagtaagcaatacgctcaatttgagtttgaggtcgatttctggagcattcgagttcttttccagtaaacttttcaggtttaagcgcggattgatggcagagctgctgtagatttggagcatttggggttggttttttgcgatttgaggatcgaatcgggcggtacaaccgcgctcacgtgcatatataaggcgaatggcggttgttggctacaatgttcggtctatntgaaggtggtgcgaat

SEQ ID NO: 4537 - DNA, 283 bp, Zea mays
  misc_feature: Incyte ID No: 700348592H1
  unsure 260: a, t, c, g, or other
gcacctctctccatctccctgctcctccgccttcttcttgatccagccaagccagggatcgccatgtgcggactcggaggagcaccacttcgaatcgaaggccgacgccggagcgtccaagacctacccgcagcaggctggcaccgtccgtaagaacggcttcatcgtcatcaagaaccgcccctgcaagttgtggaggtttctacctcaaagactggtaagcatggtcatgccaaatgccatttgttgccatagatatntcaagggaaaaagctcgaagata

SEQ ID NO: 4538 - DNA, 282 bp, Zea mays
  misc_feature: Incyte ID No: 700348593H1
  unsure 215, 248, 258, 277, 280: a, t, c, g, or other
ggaccaggtaagcagcagcaggaaccctagcaccgccgcatccgcagccatgggtatcgacctcgttgccggtgggaggaacaagaagaccaagcgcacagcgccgaagtccgaacgatgtttatctcaagctccttgtcaagctctaccgtttctggtcaggaggaccaagagcaacttcaatgctgtcattctcaagaggctcttcatgagcnaaaccaatcgcccaccaatctccatgcgccgcntgtcagttcnggaaggaaagagaagaacntgngt

SEQ ID NO: 4539 - DNA, 287 bp, Zea mays
  misc_feature: Incyte ID No: 700348601H1
  unsure 32, 225, 244, 256, 273: a, t, c, g, or other
gctaaaacatctaaacacagggattatgaggnaaggtcgcactattatgatgctctattagcagctgaatcacgggctgagaaagcaaagaaaggagtgcattctcaaaaagaatctcctgtgatgcatataacagatttaacaactgtatctgcaaagaaggccaaagatttccttcccttcttgcagaggaacagaaggcattctgccgttgttggaatatgntttagtggccatcggttcnaactaacaattncctaaggggacttgcangaatgcctcccata

SEQ ID NO: 4540 - DNA, 287 bp, Zea mays
  misc_feature: Incyte ID No: 700348602H1
  unsure 22, 24-25, 40, 47, 56, 59, 72, 82, 86-87, 89-90, 92, 106, 109-110, 121,: a, t, c, g, or other
caaaccgcacctcatccctgtngnncacgacggtggcgcncatcctnctccccganggnggcgctgcatccncccccccganggtnntnncnaacgacctgctggnttnncttcgtcttgnccgacacngatcctcaccactnatgtcngcngaagttgccggaggaaaccctnatttcctnncatgctactntcnggtncataatacngcatnaaattcccgagatttcantgattacaagtgggacataggagtnttgtgcaaaatacttcctacangtgaatna

SEQ ID NO: 4541 - DNA, 277 bp, Zea mays
  misc_feature: Incyte ID No: 700348604H1
ccttgatagcatggggcccctggccaggagttgctgtgccgtgtccaagggccgtgccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctccccaataccagcaggaggttctgggcctctgaacccctttccccacacctcccctgctgctgtgccccagcgtcttga

SEQ ID NO: 4542 - DNA, 281 bp, Zea mays
  misc_feature: Incyte ID No: 700348606H1
  unsure 15, 24, 31, 50, 104, 117, 121-122, 124, 146, 260: a, t, c, g, or other
gtcccccttctcttncctcatggnggcggcngcggcgtcgacgcgaaggngagtggcggacggcggggcatcccggcagcggccttcgttgaggacgttgaggnctacctccgccangtcnntntcacgtcaattccgcgctcgcntttctccaggaaaggctgcagcagtacaaaaatagtggagatgaagcttctagcacaacaaagggatcttcaggcaaagattctgatatagagaagtgcttggatattgttacnacattacaagctaaaaaggat

SEQ ID NO: 4543 - DNA, 279 bp, Zea mays
  misc_feature: Incyte ID No: 700348607H1
  unsure 278: a, t, c, g, or other
gtccactaatgcgttcagcattgcaactgctgctgccaaatgctgagcattcgttgccaacatagatggttcactctgataaaactgtcaccttcaatgggaggatgctcaggttttgagaccgaacctatatgtaccaccaaaacaatatcctaattgcaaggaaggtgacttcctctcatcatcgcgatgactagcaaccatgggcccgataggtgttatgcaagtgtagggcgacatcattaatgcctcggaaaacggatgtggcatttcgtggng

SEQ ID NO: 4544 - DNA, 286 bp, Zea mays
  misc_feature: Incyte ID No: 700348608H1
  unsure 11, 244: a, t, c, g, or other
taacgacaggncccaaaccccaattccacaatgaggccgtcgttgatgagatccacctcccagctcctccgccgccggagctactcctccgcatccgggcagcccgagcggaaggtggccatcctcggggcggcggggggcatcgggcagccgctgtcgctgctcatgaagctcaacccactcgtctcctccctctcgctctacgatatcgccggcaccccaggtgtcgcggccgacgtctccnacatcaattccccggccttggtgaagggtttaatgggtgatg

SEQ ID NO: 4545 - DNA, 280 bp, Zea mays
  misc_feature: Incyte ID No: 700348609H1
  unsure 55, 62, 113, 155, 277: a, t, c, g, or other
ctcgagcgtattaaatcctagtcgaagcaagggagcgcgcactccactacccaanctgatcncgaagatcgcgtccacagagacagtagccgcgtcatggcgaccccgccgcngccgctcccgcccatgccgccgaggcacgtctcctgcggctncacttctacaggaactgcaggaactatggggagaattggtcaggatgaattcaaaagagataggatgatactgcaactggaggaggattgtctcaagtttacaagcaaaaagtgaatcagantag

SEQ ID NO: 4546 - DNA, 279 bp, Zea mays
  misc_feature: Incyte ID No: 700348611H1
  unsure 53, 237: a, t, c, g, or other
gtcatactgaattttggaaagtccgtagcaagaaagcacatcccagctgaaantgcctggtctactccattaacacctcctatgccctggggtcagtcatcaaggccagttaacggctcccgccatccccaaagtcctaaacactatgggtatgctccaatcagcggtgtacttccagcaccaccagttggagctcatcacgtcccaccgtctgatgggatgcagccactaattgtnagccctgctcctatttctgctgcagccatactttcacgccaa

SEQ ID NO: 4547 - DNA, 278 bp, Zea mays
  misc_feature: Incyte ID No: 700348612H1
  unsure 34, 65-101, 122, 134, 145, 167-169, 174, 189, 205, 210, 222: a, t, c, g, or other
ggttttctcactaaatttctattttctgatagcntattacattttacacacgtgcatgcgtgcannnnnnnnnnnnnnnnnnnnnnnnnnnnnnnnnnnnnggagttttttttccaaatgtntaaatcattgcnggtaatgcctngctatgtatgtgttttagactnnntcggnaggagaagacactcngggtccccatctttgnacagnagagactacttncctttgaggtagttctgagtgtgcagagtatgccgatgtaaaaagtatccccagtg

SEQ ID NO: 4548 - DNA, 275 bp, Zea mays
  misc_feature: Incyte ID No: 700348613H1
  unsure 16, 65, 251: a, t, c, g, or other
gatctgccacctcgcngtctcgcacgttcctttccccaactccccagcgcctctcccgcgccgcnatccagatccaggttgttcagcatgggtctggtgaaggaaggcgtcgacatggaggagggaaccctagagatcggcatggagtacaggactgtatctggtgtggccgggctctggttatcttggataaagtaaagggcccaaagtaccaagaattgtaaaacatccgacttggagatggcaccacncgccgtggtcaattcttgaattga

SEQ ID NO: 4549 - DNA, 276 bp, Zea mays
  misc_feature: Incyte ID No: 700348614H1
cacccttcccactcttctccctcccatctctctcgctccatcctgggtcctggcgtaacgccgccgccgcagggaacagcaacgccgtcgctccctttacctcttcagcctgctcgccttcctaggaagtggacgccacatgcgccgcctggctcctcctctctccttccccttcccctttactgcgtcgaatctttgctccattgaagctgactgtttcatcctccattaatggcgccgcagcccttcttctcccctccggcgcctctctgctcc

SEQ ID NO: 4550 - DNA, 276 bp, Zea mays
  misc_feature: Incyte ID No: 700348618H1
  unsure 35, 153, 212: a, t, c, g, or other
cggattctccacaaatggccctggatccgttcgtngctgctctcttatctgctcttccatccaagcatgtatgcccacccccaatacggaccatcgccggcctcctgcagctaggctgccatcacctccttcaagattcattggctatcgtcnttgccatggcgtgcacatacgtgtacagttgggggtcgagcagccagctgctggacgangatggatggatcggaagatgccatgcatggatcgagcagcggggtgtccaaatcgcgcgcctag

SEQ ID NO: 4551 - DNA, 265 bp, Zea mays
  misc_feature: Incyte ID No: 700348619H1
  unsure 33, 79: a, t, c, g, or other
cccaattctaagcgagacggggcacaggaagangagagcctaaaacactaaccccccgaatcggatccggccgccggancgcggaaccccaccccggccgccatggagatgggagggatgagcgacgctgagcggctgttcttcttcgagatggcctgcaagaactccgaggtcgcgtacgagcagaaccccaacgacgccgacaactgacgccgtggggcggcgcgctgctggactgtcgcagttccgaaccggccccgacagc

SEQ ID NO: 4552 - DNA, 272 bp, Zea mays
  misc_feature: Incyte ID No: 700348620H1
gaacacagggcacacgcacggcacgcagatacatatagagagaggttagctatagcttgcacatctatttaactaactaactaactggctagctagctcgatcggcagagcaaagcgaaagcagcaagaagcaaagcaatggagaaccctgcgagtgtgctagttctaccagcgcattcaccaaactcacttccgaaactgtacatccgccgggccggccgggcagcagggagataaccgaggagggcagctgcgacttggacaagagatac

SEQ ID NO: 4553 - DNA, 269 bp, Zea mays
  misc_feature: Incyte ID No: 700348621H1
tccccatccccatccaagaaatactacgcccatcggatccaccgccgaggcaggcagaggagcacacaccccaggagctgaggaccggtttcgccatggccgccaagaagctggtgctcaagctggacctgcacgacgacaaggacaagcagaaggtgctcaaggcggtctccaccctccacggtatcgactccatctccgtggacatgaagggctcgatctgacggtggtcggctggcggacccgtcgagtcttggcaaggtgcgaaa

SEQ ID NO: 4554 - DNA, 279 bp, Zea mays
  misc_feature: Incyte ID No: 700348622H1
  unsure 36, 42: a, t, c, g, or other
ttccctgctgagaaggcgaaagacctgatgcaaatngccagnaagggttcatccgtagcccagaaccctggcctgctgcctccttccacagctgcaaccgttactgacagcaccaagattcgcagcagtgccagccgcaccaattgctgtggccaacgcccagtagagtgcagcagatataccgcaggctcccaaaggcatctcttcggcaagttccttgagaagagaaaggatcgccttactgcgaaagcaccgtacccgggttccctttaagtgtta

SEQ ID NO: 4555 - DNA, 281 bp, Zea mays
  misc_feature: Incyte ID No: 700348623H1
  unsure 9-10, 13-14, 254-255: a, t, c, g, or other
gttgattgnntgnncccagtctgcaacttgtgtcaatgtgaagataattctttaaaaattgtatctgttaactccgggctatgcttcacttgtaaccaatttgatgccttatgggacagtgtcgtgcattctgatatttgaaccaaattacattgtagctattgaagacagcagaaacctgcatatctgggaaatggttgatgggtggagtgagatatcctgagcagtatatggattccctagtttgggtaacnntgggtcccatactggagcttacaagg

SEQ ID NO: 4556 - DNA, 278 bp, Zea mays
  misc_feature: Incyte ID No: 700348624H1
  unsure 2, 179-199, 224, 267, 271, 274: a, t, c, g, or other
gnaatgccagtggtttcattcagcaagcctctgaatcgagcaggcctaaagggcctattatcaaggagttgtcttcagatgacgaggataaaccagaggatgataaagaagatggcaagaagaatggcaactttaggaagcatccaagggaaagcagagaaccgtgtgtggaggacccnnnnnnnnnnnnnnnnnnnnnttataaaaagactaaacatagacanttgggagggaactcagcagatctggtacatcacgtctacagcntcanacntttt

SEQ ID NO: 4557 - DNA, 222 bp, Zea mays
  misc_feature: Incyte ID No: 700348625H1
cggaggcgggggagaggaagacccaggagccgccgcagcaaggccagggcctcagcctctcactcgccaacggcagtggcaggtctggaatgttgccgatgtcgaacgtgtccgctaatccttcacagcttacaattttctatggcggatcagtatgtgtgtatgactcagtgccaccggaaaaggctcaagcaattcatgcttatagctgcagtgcacggc

SEQ ID NO: 4558 - DNA, 272 bp, Zea mays
  misc_feature: Incyte ID No: 700348626H1
  unsure 23, 28, 34, 165, 270: a, t, c, g, or other
tcctcctttccgtcttacttgcnttggntgctgntgctgcggcgcagagtccatggggaagcctccgccgtcttcatcgatgcctcgtcgcaccgctaccttcgggaccagcaagccgaccaccaggacgcttcaatgtcgttaaatgaagtttctgcggttgtntctgtctgcttggtttcgcaccgtcaacatcctaccagctatttcttcttcgaagttgaacaaagttcttcttcctaatccattgatagaccgcgtgctgttttncc

SEQ ID NO: 4559 - DNA, 97 bp, Zea mays
  misc_feature: Incyte ID No: 700348627H1
  unsure 2: a, t, c, g, or other
gnagacctccgccaccggaggttcctgcgggtgcgtttgccctgatcagaacactggaggtcccctgcgggtgcgctacccctgacccaagcaacca

SEQ ID NO: 4560 - DNA, 271 bp, Zea mays
  misc_feature: Incyte ID No: 700348628H1
gtgatatcaaagattcgagctcaaaggacagcacaggaaatagaaaagaaagaagctattaggagggccaggacactgattgcagaagcagaaaaggctgctgatgctctggaaactgctgcagcgatgaaccctttgcccaagcatcacttatagaggctagaaagcttgttacagaggcaagagtatcacttgaatgtgttgatgatgaagagcctcaagaaatgctttccatgatgtgtcaggagctcatgttactgaacttgcacga

SEQ ID NO: 4561 - DNA, 273 bp, Zea mays
  misc_feature: Incyte ID No: 700348629H1
  unsure 50, 79, 81: a, t, c, g, or other
gcttgcaagcgctgtgcgtgctggcctggtgtcagtcacctgagcaaggnagaaagatgaccacgctgcctcgcggggncnccgcggcggcggactccgaacagcttttggtagaagcacatggctctacacgaacgctgattttgaataggccaaagcagctcaatgcactctcctctgaaatgattaaaggtctcctatggtatttcacagcttttgagaaagatgatggagtccagattgttgattatgaaggggaatagaagagtattt

SEQ ID NO: 4562 - DNA, 273 bp, Zea mays
  misc_feature: Incyte ID No: 700348630H1
  unsure 218: a, t, c, g, or other
gccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggttgactggctgtctacacttncgttttcggctgctccctcgtcccaagtatatcaacgtagcaagtggtttaacca

SEQ ID NO: 4563 - DNA, 271 bp, Zea mays
  misc_feature: Incyte ID No: 700348634H1
  unsure 67, 179, 206-207, 232, 240, 266, 270: a, t, c, g, or other
gtctgacatgcgtgcgagtcgacgggttcagaaacctgagatgcgcaaggtagctgacgagcgggangcccttcacgggccgcaaccgctggccgaccctgatcttctgtgaagggttcgagttggagcacgcctgtcgggacccgaaagatggtgaactatgcctgagcggggcgaancagaggaaatctggtggaggctcgaanngatactgacgtgcaaatcgttcgtntgacttgngtataggggcgaagactatccgaacnatcna

SEQ ID NO: 4564 - DNA, 271 bp, Zea mays
  misc_feature: Incyte ID No: 700348636H1
  unsure 21, 24, 34, 76, 78-79, 93, 95, 151, 156, 158, 165, 175, 177, 198-199, 205,: a, t, c, g, or other
gaagactatttgcatgcttcngtntaaatgatanttagaaggaaatttcatggattaaaccatgggtttaatagcngnnaaggaaacttacantntccctttatatataacatggcatcttgttttggattgtgtcattttttaatatagnctgantnacttcanagaaagcagntntttgaattctaatacataggnngtatantgggnantagtcattttgagtgctnagcaccatntnacccggtanacggtcattctnaangannng

SEQ ID NO: 4565 - DNA, 265 bp, Zea mays
  misc_feature: Incyte ID No: 700348638H1
  unsure 215, 249, 252: a, t, c, g, or other
tgatatcaaagattcgagctcaaaggacagcacaggaaatagaaaagaaagaagctattaggagggccaggacactgattgcagaagcagaaaaggctgctgatgctctggaaactgctgcagcgatgaaccctttgcccaagcatcacttatagaggctagaaagcttgttacagaggcaagagtatcattgaatgtgttgatgatgaagagcntcagaaactgctcccatggtgtgtcaggagctcntgntactgaacttgca

SEQ ID NO: 4566 - DNA, 271 bp, Zea mays
  misc_feature: Incyte ID No: 700348641H1
  unsure 26, 32-33, 235, 251, 253: a, t, c, g, or other
gggctcggtgccccggccatccatcnccttcnnaatctcgatccgccctcaaagggagtgcaagcctcctccagcctttcctttcaaatcggatttgtttgctcaagttgcaagatggataagatgaccaaggttgcagtttgtgttgctgctgcacataacttactgtgcatgatggccgtgattattgcgtctagacaaagaaaacgaaatgcaaggagcgcacagattaccnatgcaccattgcagtnantggtaaggctggggatga

SEQ ID NO: 4567 - DNA, 268 bp, Zea mays
  misc_feature: Incyte ID No: 700348643H1
  unsure 6, 78, 82, 86, 124, 163, 186, 192, 196, 222, 225, 232, 234, 251: a, t, c, g, or other
atcgcngctgcgccgtctcctccgctcccgtcgtccggaaagatggcgtcccacattgttggataccctcgcatgggncccnaganggagctcaagtttgcacttgagtctttctgggatgggnagagcaacgctgaggatctggagaaggttgctaccgacntcagggccagtatccggaagcanatggcngatnctgggatcaagtacatccccagcaanacnttctcgnantatgaccaggtcttganaccatgccatggctcgg

SEQ ID NO: 4568 - DNA, 269 bp, Zea mays
  misc_feature: Incyte ID No: 700348644H1
gtacctttctgagatccaaagtagccagccctcgaaatctgagctggaacagtacctggacgaatccctcactccacgtatccaggagtttgatatcctgaactggtggaagctaaacacggtcaagtttccaaccctctctaaaatggcccgtgatatcttggccattccagtgtccatggtaagcagtggcagctctatattctgtgctggaacaggaagtcacatgctcgatgactacagaagctctctgcggcctgagattgtgg

SEQ ID NO: 4569 - DNA, 263 bp, Zea mays
  misc_feature: Incyte ID No: 700348646H1
  unsure 16, 148-149: a, t, c, g, or other
aaagttgccatttttntcgactgtagtccaaccgctgagcctctgtttgagggtagaggctctgaagaattgtctgctgagctctctgtttccctgcaaagatgcttgttgggtggtaaaagtggtgctggtgctgcaattgatctgnncatccctaattgttgttgatggaaaggtctgctgggatctgtaacatgatgggcttgtggtcattctgatggtaattgctagatgcgctactgttgcgataaaggttgctttga

SEQ ID NO: 4570 - DNA, 270 bp, Zea mays
  misc_feature: Incyte ID No: 700348648H1
  unsure 18, 42, 47, 54, 61, 71-91, 150-151, 161, 194, 208, 237, 252: a, t, c, g, or other
gcttccgatgcgccgganctcgcacgcgatgggagcgcaagnctttnggctgcngctgctnctgctgctcnnnnnnnnnnnnnnnnnnnnncgcttcgttgtggagaagaacagcctgatggtgacgtcgccgacttcgttgcggggacnncacgacagcnctatagggaattcggaatcccacagtacggcgngagcatggcgggcncgtcgtctacctaaggacaacgccaaagncttgcaacgatttcnaacggcaggcaacccttc

SEQ ID NO: 4571 - DNA, 269 bp, Zea mays
  misc_feature: Incyte ID No: 700348651H1
  unsure 172-173, 187, 229-230, 237, 250, 264, 266: a, t, c, g, or other
ggctgctcctgtgtcgtcgtcaattaaatacggtgaagaatctgagggccttaacatggtgcaggagtatgtcaagtcgcactagatgtgtgacatgtttcagtgatactcttgatttggacctgggcttaaaattatgcttttgcatctggggctgcctaggagattagannatttactagaaganccgaagaggatatgtatgaacaatttggacatctgaattttnntttgttnaggagctgtcgtntagttttaagcaancnagg

SEQ ID NO: 4572 - DNA, 134 bp, Zea mays
  misc_feature: Incyte ID No: 700348653H1
  unsure 10, 12, 15-17, 22, 36-37, 48, 66, 107, 112, 114, 119, 129: a, t, c, g, or other
atagataagngnctnnnctagntgctgtgggtcatnnggcagaggtgntctctatcagtgaggatngcagcgaggagcgcactgaagccagcagtcgatgagtcgcntcctntngcggnagaaccttgncgcag

SEQ ID NO: 4573 - DNA, 272 bp, Zea mays
  misc_feature: Incyte ID No: 700348654H1
  unsure 92, 100, 103, 105, 112, 114, 140, 204, 210, 244-245, 250, 257, 261-262,: a, t, c, g, or other
gtctattgaaggaatgtgatgagtgcattgctgaggaatctagccaggcaccagcaaagaatgtcgaggctcctgtagctgctactgttgangacaaggnggntntcgcaantntggataatacaccgccagtggtagancccccaagcaaacctaaatataggcatgactactacaacagtgccacagaatggtcctcacatnttgccnaagggtgttccgctgataatgtatcattgattcnntgatnagatgtngagnncnncccttca

SEQ ID NO: 4574 - DNA, 275 bp, Zea mays
  misc_feature: Incyte ID No: 700348656H1
  unsure 22, 43, 61, 69, 87, 114-115, 129, 131, 151, 157-158, 160, 168, 194, 215,: a, t, c, g, or other
taacgggttcgggcggctcgtntggtccagcgaccaccacgtngtcgccagcccgatcgcngcgacatngacctattggctagcggnggccgtaccgtagcaatagcgagatannatcccgattggggnantgcaatggcgagcgcgcgcnattctnnantgcgaganagatggcggatatcgtcgaggatgtnctgttgtattgtgtgcatgantccgctccggtgtgtaagctgccggtgtagtgtaatctatctgtagctganccgantgta

SEQ ID NO: 4575 - DNA, 278 bp, Zea mays
  misc_feature: Incyte ID No: 700348657H1
  unsure 260: a, t, c, g, or other
gttaacaatagattctttagtaacctcttttatgtgcaaagcactaagaatgcactgaccgacatatcaaaataggcagagtgtggcaccttggtctgtcctgtctcaatcaatagtcaccacatttgtcatatgttagttacttgatttattgtttttctgaataaatgctgatactgctatttataatttgcatggctcttcatagttatgaacttatggcaccattggatttgtatgggaacaagtactctcacaanagatctttatctaattga

SEQ ID NO: 4576 - DNA, 258 bp, Zea mays
  misc_feature: Incyte ID No: 700348658H1
  unsure 2, 23, 39, 229, 244: a, t, c, g, or other
gnctggatgttccagtagacaantatcctaactacaaanttgttggtcgtttattggggccgcgaggtaactccctgaaaagggttgaagcttcaacccaatgtagagtttacattcgaggacggggttctgtgaaagactctgttaagagtttccagcagatatggttgatgtgcgtcttaatcaagctgtgtccatcctagaggatcttcttaaaccaattgacgantccagggctactacnagaagcaacagctg

SEQ ID NO: 4577 - DNA, 180 bp, Zea mays
  misc_feature: Incyte ID No: 700348660H1
gtcctgttagtctatgctacgttgtctgcaataacggacgtgacccggggaaaaaaaactgtttcgtcacgggtagctagagaatcacgtaatggctcttgttttcgtttgtgtcctataatgtatggctattggcctgtttcgagaggttaaaatttggaggtgctgcatcaaattcgt

SEQ ID NO: 4578 - DNA, 277 bp, Zea mays
  misc_feature: Incyte ID No: 700348661H1
  unsure 2, 69, 118, 195, 206, 227, 248, 252, 258, 260-261: a, t, c, g, or other
gnatgttcgccggagcaaagttggaggtggaaacagtcgtgagatggactttgaaagctttcttgattngcgttttggctctagaaaacaaagatacccctgaaggcttgacatattnatttaggtgccttgatctcaatggaaggggtttccttacaactgcagatattcatactctatttgaggacgtacacnagaaatggacngtgggagggacttgagccttncatagaagacgtgagggatanatcnggacangnnaaacccgcagatccct

SEQ ID NO: 4579 - DNA, 276 bp, Zea mays
  misc_feature: Incyte ID No: 700348662H1
  unsure 21, 43, 51, 162, 173, 180, 212, 248, 254, 256: a, t, c, g, or other
ctgcgagctggagtacgggancgcggagcagcgcaggttcaanctctacancaacggcaagaccgccgcggagaactacgacgtggtcgccaaggccgggggcaagaacaaggcgttccacgaggacttccttgacgacgacgacgccgcccccgcgtcggngacggacacgntctgggntcagctgggctccgagtcctccgcgaccagcnccgcggctaagacgcgctcctgaaggcatgagattnaaggananccggaaggaaaccttggcat

SEQ ID NO: 4580 - DNA, 281 bp, Zea mays
  misc_feature: Incyte ID No: 700348663H1
  unsure 101, 226, 272: a, t, c, g, or other
tccgccaaagtatggtgccatgattatggaagctctttcggaattgaatcagccgaatggttcagatattgatgcaatcttcgacttcataaagcaaaggntgtggtgcaatcgacctttagaagatttctaccctcaaagttacggcgacttgcaggcctcaaacaaaattgaaaaggtcgataacttctataggctcccagattcatttgcaacaaggactggngctcaaataaaagtttcgatccaaaacagaggatccatctaaggcntaaagacca

SEQ ID NO: 4581 - DNA, 284 bp, Zea mays
  misc_feature: Incyte ID No: 700348665H1
  unsure 44: a, t, c, g, or other
gggcctctcgggactctagagtggcggccggctctccgcctgtncttgtcgtcgctgctcctttccctgtgagcttaaaatatacacaggatgtcggaacgttctgagagtgcaactgaaaagattatgagcagcatcatggataccattgctgacaaccttcctaagcagaagtctgggaaatttgatccaggttcagtctctgacaaagtgaagaacaagctgtttggtcgtcagaagaccttgcaggagttctgggtggtggaaaacctgctgatgtgctg

SEQ ID NO: 4582 - DNA, 281 bp, Zea mays
  misc_feature: Incyte ID No: 700348666H1
gggagctaaaatggttgagattggaaactatgattctttttatgagatgggcattgagttctcctctgagcagatactgaagctaacaagggaaacaaggaagatgcttccagacatcaccttatcagtaacagttcctcacacacttagtttgccagatcagatgagactagcagagctactcgaagaggaaggagctgatataatccaaactgagggtgggaaatgttctagcccgacaaaacctggagtgcttggattgattgaaaaggcaacaccac

SEQ ID NO: 4583 - DNA, 277 bp, Zea mays
  misc_feature: Incyte ID No: 700348668H1
  unsure 2, 61, 85, 95, 165, 171, 228: a, t, c, g, or other
tnaaatactgccacccaccaccgcgccgccgcgccatggcttccccatccccttcctcgcncctcccacccgcaccagcacccanctcctccgantgttcaccaccaattccaatccctaccgccttcgatgccgccaccgccgccgtcaacggcgctgccaaangcgctncgaccttgaggttaccgtcgtctgcgggaagcacctgaagaatgtcaactgggcgcngtggcgacctccgtgctacgtcgtggtgtacttgacccctccgccgggc

SEQ ID NO: 4584 - DNA, 279 bp, Zea mays
  misc_feature: Incyte ID No: 700348669H1
  unsure 8, 55-56, 160, 189, 274: a, t, c, g, or other
gcggcagnggagtgcagagagcggacgcaacgcaacaccgcccactctctatgcnntgacgatcgaagcgaggagcgcactgaagccagccgccgatgagtcgcctcctctcgcggcagcaccttgccgccgtccgtgcgatctgcaccctttgcgtgcntgtccaggtggctgcacacgccgtcattncgcgacggtgtctccgcaagaggtttcaggttccagcccagcggaagtgcagaattttgtgcaggcagctggacagcatctgctnaactg

SEQ ID NO: 4585 - DNA, 271 bp, Zea mays
  misc_feature: Incyte ID No: 700348670H1
  unsure 2, 55, 120, 223: a, t, c, g, or other
cnacgaagagccgcagaggagggggaggtgctgggtgggatccggcggaccgctncatgtcgagcggcgcggaacggatcggatccctgcacgggccttgacccggggacgatcccaganctgccggcccatgagcctcctctgctgcaggctccgtcgccggcgccgcagcaggaggtggtggtggcgtcgcagaccgaggcgccgttgccagcggtcaccntcgtgatctcgcggccaggcgaggatgttcagatgcccgatgcaatgg

SEQ ID NO: 4586 - DNA, 276 bp, Zea mays
  misc_feature: Incyte ID No: 700348672H1
  unsure 21, 88, 105, 132, 149, 155-156, 164, 181, 210, 215, 228, 231, 239, 242,: a, t, c, g, or other
gtttcacttactagtgaagtngaacaagaaagctaaatgaaatagacttagaaatgttcataactttgtatgctactggagtgaaggntatttaaattctagganacgacttaggtttggatagtggacccnctattttgggctatatnatgggnngattcganattccaaatggagctcnatagctctctacgagggaaaatgggcatnattcntacccttctaaantcncatttaanggnantgctctcacctgatcttaaccaccttangttt

SEQ ID NO: 4587 - DNA, 270 bp, Zea mays
  misc_feature: Incyte ID No: 700348675H1
  unsure 15, 27, 113, 152, 171, 207, 229, 234, 246, 263, 265: a, t, c, g, or other
tcaaccataccagcngcgccgcaggtngaccgaggaggcggagtagagtggccggactacctcgacacctccactgcaaccatgggtatctcacgtgattcgatgcacaagcnccgggccaccggtggaaagcagaagacgtggcgcaagangcgaaagtatgagcttggncgccagcctgctaacaccaaactgtctagcaataangcagtgaggagggtccgtgtcntggangcaagttaagtngaggctctccgattgananaggta

SEQ ID NO: 4588 - DNA, 277 bp, Zea mays
  misc_feature: Incyte ID No: 700348676H1
  unsure 2, 7, 9, 244: a, t, c, g, or other
gngtcancnagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcanggatcccaccatgcggcgtggggtggggagcat

SEQ ID NO: 4589 - DNA, 145 bp, Zea mays
  misc_feature: Incyte ID No: 700348678H1
  unsure 86, 96-98, 103, 105, 128, 134, 143-144: a, t, c, g, or other
gacctatcttatttcagtagatgaatgatggcgacaaaagccatccatccatatggcgaaccggatggtgattcgatagtttagcngacacatcgnnnccatntnactcgtccttcataaataactanatggcnactaaaganng

SEQ ID NO: 4590 - DNA, 268 bp, Zea mays
  misc_feature: Incyte ID No: 700348682H1
accggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgctttcgatgccgggtccaagaagaagttgctcatctttgactccgaggaggatctctcggtttctctggcgaatacactgcggagtgtcggagaagttcgcggccgagaggggtgctttaccg

SEQ ID NO: 4591 - DNA, 271 bp, Zea mays
  misc_feature: Incyte ID No: 700348683H1
  unsure 21, 53, 56, 58-59, 78, 161, 210, 219, 243-244: a, t, c, g, or other
caaaccattgttggacgcgtncccctcctgcacgcaacctcatctcgtcctcnagntnnaggatggccgtcctccttnagaccttgcctccccgagtgctctcggtgagctactttgtttcgatttatcaggaaatccgtttgcttacatgttgtgcaggntacatatctgattgctggattcggcaaacccgcgtcggatcctgtatcngttagtacntggccgcaggttctgttgttttgnnttggtggtcgagcatcgcatgttctga

SEQ ID NO: 4592 - DNA, 270 bp, Zea mays
  misc_feature: Incyte ID No: 700348684H1
  unsure 36-37, 43, 55, 76, 84, 100, 125, 136, 143, 157, 160-161, 191, 206: a, t, c, g, or other
ggagggcaggaagaccgaagaccgagccgtgcggtnnctcggnacgggaacggtnccaggaccttcaaaatctcanttccttcntgcccgcccgcccgtncccgtcgacgcgtcgttcttgccgnttgcgccccanctccgcnctctcctcctccanggnnatcggatacgccacaggctgcgcgatggtnctgtgggtcttcggnctacggctcccctcatctggaaccccggcttcgattcgacgacaaaatccatcggcttcatcaa

SEQ ID NO: 4593 - DNA, 260 bp, Zea mays
  misc_feature: Incyte ID No: 700348685H1
  unsure 46, 186, 219, 250: a, t, c, g, or other
ctttgcatctgcaaccccgcccgatcaatcttcctcgttccgccgntccctcgcctccggcagcgaggtgaggccaccgatcggaccttccctagcggcggcgcctaccaacctcaaggagcgatggctctgtctgcgacgctacggatttctcttagcgtcgcgttctttggggattttgggtcntgcctggtgtcatcgccgaaaacaaaaagctgntccgggactcctatctaggaaaggagtcgtnattgcagttt

SEQ ID NO: 4594 - DNA, 261 bp, Zea mays
  misc_feature: Incyte ID No: 700348687H1
  unsure 2, 35, 53, 79, 96, 98, 102, 104, 116, 122, 173, 180, 183, 186, 191, 208,: a, t, c, g, or other
gntcgctttctactagctctcgacgcgtcgccgcngaccacagcacggctggngtgtggatccctcccgctctcctcgnaggatctccacccggcntngctntntctgagtcccantggggnagagatccgtgagcgcgaggactggtcccttcttgggttgggttcttctcnagttcgnganttngcaantggttgaaactgattgnagaacttcgtggtgcctgattggatnccgggnncggtttncnnnccaaaaatt

SEQ ID NO: 4595 - DNA, 267 bp, Zea mays
  misc_feature: Incyte ID No: 700348691H1
  unsure 3, 8, 14, 18, 118, 131, 133, 182, 186, 216, 221, 224, 254-255: a, t, c, g, or other
tgnagganaagtgnctcnatgggaggctttatgtgaaaagcacaatgcagtgatagagctgttagtagagagtggtgcagagctatcatctggagacacggccttgtatgcttgcatncgctgttgagganantgatgctgagttgttgctggaacacggagctgacgtcgacaagcggacngttntggctggtcgccaagagatctagctgatcngccangcnatgatgacattcaggctctcttcaaatcannaaaagcacacag

SEQ ID NO: 4596 - DNA, 271 bp, Zea mays
  misc_feature: Incyte ID No: 700348692H1
  unsure 29, 39, 66, 114, 221, 263, 268: a, t, c, g, or other
tccaaccattggtatttctgttgatcacngccgcaagancaaatgcccttgagggactgcaggccnatgtccagaggcttaagacatacaaggccaagctggttatcttcccanggcgtgcacacaaggttaaggctggtgactctactccagaggagcttgccaccgctacccaggtccagggtgactacatgccatttactcgtgggtgagaaacgttnagttgaggtttgaaggtcacagatgagatgaagtcatttcgncctangca

SEQ ID NO: 4597 - DNA, 155 bp, Zea mays
  misc_feature: Incyte ID No: 700348695H1
  unsure 45, 56, 77, 83, 140, 154: a, t, c, g, or other
gtcatgggagcatggtgaaccagagtgtaccccttatggatccgnttgtgacacantttggtagtgtccatgagaanatgccncaagctggaggaagtatgaggagcacattgtttccaaactttggaagtatgttcagngtcacagatccagnc

SEQ ID NO: 4598 - DNA, 305 bp, Zea mays
  misc_feature: Incyte ID No: 700348703H1
  unsure 48, 57: a, t, c, g, or other
gcatcttcttgtgcagtgccagcctcgtctcatagacaagatggtgancgtcggtgncaacggatttggccgtatcggacgcctggttaccagggctgccttctcttgtgacaaagtggacattgttgccatcaacgaccccttcattgacctcaactacatggtctacatgttccagtatgactctacccacggcaagttcaacggcacagtcaaggctgagaatgggaagctggtcatcaacgggaaacccatcaccatcttccaggagcgagatcccgctaacatcaaatggggtgatgctg

SEQ ID NO: 4599 - DNA, 304 bp, Zea mays
  misc_feature: Incyte ID No: 700348705H1
gggaagaattcgagtccaagtcttggagctctcgctttaggcggccagggtggaactgccccttgcccgtggttggtgaggcgattcgtggtcgggagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttctcctgttgggtcagaaagagaaagtcaaacaga

SEQ ID NO: 4600 - DNA, 259 bp, Zea mays
  misc_feature: Incyte ID No: 700348706H1
  unsure 65, 206, 239: a, t, c, g, or other
ctgagcagcagtctagggggtgtttgggaacaaagtttttctgcagttttggaagaatacaaatncctgcagtattctcaaatactgcagtattctcaaatactgcagtattatatacataatggtgtttggcaagctgggtaaaatctatgttttcaaaactgaagtattgcaaatactatagttgttttaaggcatctaaacantgctctggacctcagttttcaaaactgcggtantttaaactacggtatgtcat

SEQ ID NO: 4601 - DNA, 301 bp, Zea mays
  misc_feature: Incyte ID No: 700348708H1
  unsure 4, 7-9, 11-12, 15, 20, 22, 34-35, 48, 50-54, 56, 62, 67, 104, 218, 268,: a, t, c, g, or other
gacntgnnnannccnggccngnttctcgaagagnncgatccagaccanannnnnancacacnatcancctcaccttgtcttgtgtcctcatcgccttcacagcnactagcgacggctgatttgggttctgttgcatgcccctgggtctgaatgttagccactgtctcctgggctgcactgttttcttgtagtatgttgactgttgagtgtcgttggtngtgggaaaccatgtttaggactagtttgagaatctcatttttagtttcanttnctttagaaaatnagtttattttntcttgag

SEQ ID NO: 4602 - DNA, 302 bp, Zea mays
  misc_feature: Incyte ID No: 700348710H1
  unsure 198, 211, 220: a, t, c, g, or other
gccgccaccaggtgcagagtctttcgtcatctcttctccggcgaagaacccccagtcgcccaccagatcacttgttaaactttgttgaggggtgatggcggtttctttcgcaaacctcagctccgaggcagggcttaaaaagcttgatgagtaccttctcactcgcagctacatcactggctaccaagcttccaaggntgacttggctgtnctacacttncgttttcgtctgctccctcgtccaagtatatcaacgtagcaaggtggtttaatcacattgatgcgctcgtgaggctgagcgg

SEQ ID NO: 4603 - DNA, 298 bp, Zea mays
  misc_feature: Incyte ID No: 700348711H1
gggactggagatccaccactccaccagtccggtccatctgctggacctcgattggtttcttcttacctaggaacatccggggatgtcgaatcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagatatccaaacaaaccaccaatgtgcgattgtt

SEQ ID NO: 4604 - DNA, 297 bp, Zea mays
  misc_feature: Incyte ID No: 700348714H1
gtttcctcgccgcagccgcaaccgcatccaggtgggaacctagcggcattgcattgcacgaaccacttacctgtgaaaccgtgcatgctggtttgtgaaattggtgttttcgtcacagggactgcttaggggaaggttcttaaggaatggggcgcttgaagaggagcgaccaccatctgtggcagcgagggagcttgggcagttgaggcagagccatcgtatgcccgccttgagaccagagagtatgcaagtagtcaagatgttagccaatctgatgcttctgtggttgagatgtta

SEQ ID NO: 4605 - DNA, 103 bp, Zea mays
  misc_feature: Incyte ID No: 700348717H1
  unsure 59, 97: a, t, c, g, or other
gatcgttgtcctcctccgcttccctccaaatcgaccctggatctccaaccccgattttncccagcagaagcaaacccgagcaaattgagcgcttgangcttca

SEQ ID NO: 4606 - DNA, 298 bp, Zea mays
  misc_feature: Incyte ID No: 700348718H1
gggcgagcgcaaaccagcctcgcttcccaaaccctagctcctcgctctcccgcccgcgtggcctgccaggcaaccacccccggatcaactccgtacagcgtgcctccgcctcccggactccagcggcggcgggatgtggtctcactccaaggacttgctcgagatcgagcccctcgagctccgattcccattcgagacaaagaagcagatctcgtgctctatgcagttgacaaaccgaacagatgatacatcggctttaaggttaagacgacgagcccgaagaatatgtgtcggccca

SEQ ID NO: 4607 - DNA, 296 bp, Zea mays
  misc_feature: Incyte ID No: 700348719H1
gccattgccaaaattcgtcaagaattgatgcgtgacataccgttcttagtcataattgataatttggagagtgagaaggattggtgggataagagagtcataatggaccttctgccacactttggtggggagactcacttcatcataacaacacgtcttccacgagtgatgaacttggaaccaatgaagctttcttatttatctggtgctgaggcaatgactttaatgaagggaggtgtcaaggaccatccactggtggaaactgatgcactcaaaatcatgaggaaaagctggaa

SEQ ID NO: 4608 - DNA, 295 bp, Zea mays
  misc_feature: Incyte ID No: 700348722H1
cattatcagcctgccatgtcgaagaggaaaccacgtgcaaaagcctacatgttgggggcgcgtgctcgcatagttcatggcgttgccgtgaacaccatggctacccttgccgcgaccgcctataagagagatctgaggccacaccatggcgtggcacacttcctcgagctcgatccatcgttgccctccgtcgatctaccgctcagcaccccgggaggccagccgagccatagccgatctcggaggacgaccagctagagctgctgaccaggagcctgacgttgaggagtacgcg

SEQ ID NO: 4609 - DNA, 296 bp, Zea mays
  misc_feature: Incyte ID No: 700348723H1
gcgggccaacccgtacaacatagggatcttgaacaacttcatggagatattctgcaccgcagtccctccttccaagaacaacttccgagccagggtcccagtagagcaaggtttacagcaatcgcgtgcgccagcaaggggtttcatgagtctaaacatggataaacctgttggggacttcgaattgagtaggaagccagtatcatgggatgaacctcggtcagcagctgatatcagggacttggaggttggtctagggggtctactggacgagaaagaaggcaggatagcccatg

SEQ ID NO: 4610 - DNA, 294 bp, Zea mays
  misc_feature: Incyte ID No: 700348726H1
  unsure 74: a, t, c, g, or other
tagccctgggagcagaaagaaggtcataacagcaaccgctagacaaatagagagtttgatccgtctcagcgaanatttagcccgaatgcggttctctgaagtggtcgaggtgcgggatgttgtggaggcattcaggcttcttgaagtcgccatgcagcagtctgcgacggatcatgcaactggtacgattgatatggatctgatcatgacggggatatccgcaagcgaaaggcagaggcgggagaacctcgttgccgcaacccgtaaacctgattgcggagaaaatgcagcttg

SEQ ID NO: 4611 - DNA, 299 bp, Zea mays
  misc_feature: Incyte ID No: 700348727H1
  unsure 196, 211: a, t, c, g, or other
attctattggacagctgaaggagtttgagggcaagaagctcgtctctgccaccaaggagggcctgaagctggacgagagtgaggatgagaagaagcgcaaggaggagctcaaggagaagtttgagggcctctgcaaggttcattcaaggaggtgctgggcgacaaggtggagaaggtggtggtctccgaccgcgtnctggactccccctgnctgcctggtgaccggcgagtacggttggaccgccaacatggagcggattcatgaaagcccaggcgctgagggactccagcatgttctg

SEQ ID NO: 4612 - DNA, 291 bp, Zea mays
  misc_feature: Incyte ID No: 700348728H1
  unsure 179: a, t, c, g, or other
gggtcgggatcgccggagatggactggagcgcggtgacggcggaggacctggtggacgcgctgcgggaggtggactggtccacgccgccgcggactgtctcggagttcttctcccggttcaccgtcccacgctcctattccaagtggaccagccgcctcaagtgcaacctctactactncaggacaaactatttcatcttgatcatgttcatccttgggatgggcttcctttggaagccagttgctatccttgctgcttttatgactggattagcatcgcattctcaatga

SEQ ID NO: 4613 - DNA, 291 bp, Zea mays
  misc_feature: Incyte ID No: 700348729H1
  unsure 27, 46, 69, 79, 290: a, t, c, g, or other
tttttataatcgggaacaaaaaaaccnatctgtcaatattattgcnaaaaagaaaaaaaatattttganaaagaaagantgctagattctggaaattcaagtatagcgcggatgcctttcccgtatgacttatcatgcatcaagccaaatatacagattgaataattacctacaataaaaatattttatctgtagtattcagaatcacttttaaaattttctgtagatgtgaactgaggtatcgaagtctgatgtaatcatagatgtcaacatttataaagctaaaaggnc

SEQ ID NO: 4614 - DNA, 294 bp, Zea mays
  misc_feature: Incyte ID No: 700348730H1
  unsure 181, 249, 260: a, t, c, g, or other
aagcaatttgttgagatctcatcaataaaccagcgaattttgttatctggtccagcaggttccgagatttatcaggaaacattggtaaaggcacttgccaaacattttagtgctagactccttgtggtggattcacttttgctgcctggggcaccttcaaaggatccagaattccagaaangcgttgggaaggctgataaatcaggggataaggcagctgccgagaagtttgcaatatatgcagaagcntcgttcttcgntggcagacactgttcacttcaggaggccagctgc

SEQ ID NO: 4615 - DNA, 296 bp, Zea mays
  misc_feature: Incyte ID No: 700348731H1
  unsure 31, 34, 63, 69, 214, 218, 265-267, 269: a, t, c, g, or other
gtaaaaatcgccccatcccctgactatcacnggntcactgcccttccacctacaggttccagnggccancgtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaanaggncagtcgctgcagcagctattgacgaggtcgcccctgtaggtgcaggnnntngtgatggcgatgcatctgcatcagcgg

SEQ ID NO: 4616 - DNA, 118 bp, Zea mays
  misc_feature: Incyte ID No: 700348733H1
  unsure 48: a, t, c, g, or other
ccttctgtatctaagctttccgccattttcccctttatcgaagcatcnagacccagaagcaagcctggtatacaagcattgtgttcactacatgtagctcttgataaagccaaagggc

SEQ ID NO: 4617 - DNA, 290 bp, Zea mays
  misc_feature: Incyte ID No: 700348734H1
taggctcaagaatgtacaaagggaaagagaagaaaagctagctagattcctcaaggaattcctctctcagtatgttcgtggagacaaagaaggatttgctaatcgtgccgaagctgaggcaaagaagctctcatgcacttcatctgggttggatattcttcgcaccattggatatgtctattctcgacagggcagcaaaggagctggcaagaaggccatgtacctaggagtgccattcgtagccgagtgggtcaggaacaagggtcatctgtggaatcacagatcaccgc

SEQ ID NO: 4618 - DNA, 296 bp, Zea mays
  misc_feature: Incyte ID No: 700348736H1
  unsure 54, 86, 117: a, t, c, g, or other
cacccactcatccgtccgtccatccaatgcgatggtgtcgttggcgcgccggcngctactccgccgccgtacctgcgggcaacctncctcggcatccatctcttccggtgccccgancgccgttggcatcgtcgccaagctctcggaatgcatcgcctcccgcggtggcaacatccacagcgtcgacgtcttcgtccccgacgacaaacccgtcttctactcccgccagtgagtttaccttacatccaaggctctggccgcgttcatgagctccacaaggattcctcaatctctcc

SEQ ID NO: 4619 - DNA, 290 bp, Zea mays
  misc_feature: Incyte ID No: 700348737H1
  unsure 141: a, t, c, g, or other
gtactatgctactagggctgcactaggtcttacattccaatggagctcccctgttgctttcattacatgcttcgtgacactatttgctttggtcattgctataaccaaagatctccctgatgttgaaggagatcgcaagtntcaaatatccaactttggccaacaaagcttggtgtcagaaatattgcattccttggatctggtttattattagcaaactatattgctgctattgctgtagcttttaccatgcctcaggctttcaggtgcatgtaatggttcctgtgcag

SEQ ID NO: 4620 - DNA, 296 bp, Zea mays
  misc_feature: Incyte ID No: 700348738H1
  unsure 52-78, 136, 187: a, t, c, g, or other
ctctctattcgttccccgcctcaccccgagccagccgtctcgctaaggtttnnnnnnnnnnnnnnnnnnnnnnnnnnntatgcctcgccggcagcttcaggaaggtctgccccacgcccagctacccgtgctgctnccagtgaggaacccgccacagccagcacgccaggcttccttcctccagctncctgttacgagatggtggtggctccatgtttggaggaattgggtccaccatgctacaaggtatggcgtttggcacgggtagtgccatggcacacagggctgttgatgtg

SEQ ID NO: 4621 - DNA, 275 bp, Zea mays
  misc_feature: Incyte ID No: 700348741H1
  unsure 53: a, t, c, g, or other
tgaaatatatgtatgggttggacgggtaacgcaaatggaggatagaaaatctnccactaaagcagttgatgaattcctcattaatcaaaagcgtccaaagacaacgagggtaactcaagtgattcaaggttatgagagtcatgctttcaagtccaagtttgaatcgtggccagtgggtaatgctgctgggaaccctggcacagaggaagggcgggaaaagttgccgcttattgaagcaacaacgcttgatcccaagggagctgcaaaaagcacca

SEQ ID NO: 4622 - DNA, 284 bp, Zea mays
  misc_feature: Incyte ID No: 700348742H1
  unsure 20, 214: a, t, c, g, or other
ggccaagggcgacaaccagngctggaagatcgtcccctggtaaatgtgctgttctgtggctgcactggtcatcaccatgatctggagctttgaaggcatagccacctgtggtcagcaactgctgccgtgttgctagaataaagttggtggcgatcgatcgatcgatctttggtgatgggtgtccctccctgtgtgtttgtgtttagttccagtncgtttgtgaggaatcagttatgtttgagtgagaggggtacttcgctcttcggttaactctgtactgtcca

SEQ ID NO: 4623 - DNA, 280 bp, Zea mays
  misc_feature: Incyte ID No: 700348746H1
  unsure 60: a, t, c, g, or other
ttgccatctgggatctactattacaaaggttgatatattcagagatgctgcagtgcttanggtgaattatgtcgatgaaattcgagcacaaggttttaagttggagtacctgaatattggaggtggtttgggaatagattaccatcataccgatgcagtcttacctacacctatggatctcatcaacactgtacgagaattagttctctctcaagatcttactcttatattgaacctggaagatcctgattgctaatactgctgctcgtcaatagagtaa

SEQ ID NO: 4624 - DNA, 283 bp, Zea mays
  misc_feature: Incyte ID No: 700348747H1
  unsure 167-168: a, t, c, g, or other
attcagtatgtcgtgatatttagtatttattataaacctcaccataaaaacatgagcgttagttgtgcctatcttaatgtaacacattttttgtacacatcttgaccttttccgtttgatgccttgctttcaggtacttgacatttcgtgtttgatgcttgtttccnntgcagattatgaacataacaagaggtcagcgccaggttatacatcagctcgacaatctgacaaatctgctcacgagcattggtctaacacgccagactaataataccgccagcag

SEQ ID NO: 4625 - DNA, 289 bp, Zea mays
  misc_feature: Incyte ID No: 700348748H1
ggccaggggtccctcacttggaccctgctggacatattatgcgacaacacatgtccatgcctggaagatttcctccagaaggcttgccaagaggtgtccctccatctcagcctgtgcatcacatggctggttatagacctgaaatgggtaatgtaaataatttccatatgcaccctcgccagcccaactatggagaatttggattgatgatgccaggcccatcaggtccagaggtgaggggcaatcatccagaggcgttcgaaaggttgatccagatggagatgtcagc

SEQ ID NO: 4626 - DNA, 290 bp, Zea mays
  misc_feature: Incyte ID No: 700348749H1
  unsure 42, 175, 184, 276: a, t, c, g, or other
gccgttgctaccgccccgtacctcgcttgctttcccgtcgcngaaatgacgaagcgcaccaagaaggctggaattgttggcaaatatggaaccaggtatggcgctagcttggcgtaagaaatcaagaagatggcgctatctcagcactccaagtacttctgcgagttttgtgggnagtttgcangtgaagaggaaagcagttggaatttggggatgcaaggactgtgggaaggtcaaggctggcggtgctacaccatgaacatgctagtgcagtcnatgtcaggagcacg

SEQ ID NO: 4627 - DNA, 284 bp, Zea mays
  misc_feature: Incyte ID No: 700348750H1
  unsure 271: a, t, c, g, or other
tggctaaggagtactttaactttctcaataagtaccttgccacattcaaagggtcagatgatgaatcagctacaattggtgatgcgaaggaagaggctgttgcggcaatcatcgagtttgttaaatcgcctaatctctttcagtgtgatttgctcaacatgccagctgtttcacagcttgagaaggacgaaaagtatcagttggtgtatgaactactaaagatattcctactaagaagcttgattcctacttggagtttccaagtgcaaantctggacttgccg

SEQ ID NO: 4628 - DNA, 281 bp, Zea mays
  misc_feature: Incyte ID No: 700348751H1
tcgagagggagaggaggagggagtccgaggggagagacccaattaactgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcac

SEQ ID NO: 4629 - DNA, 280 bp, Zea mays
  misc_feature: Incyte ID No: 700348752H1
  unsure 2, 48: a, t, c, g, or other
gntcgccgcggctccgaatggcaacttccccgaaccccgcgacgattnaccgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtacaatgtgctacatgtctgggaacatgcaga

SEQ ID NO: 4630 - DNA, 281 bp, Zea mays
  misc_feature: Incyte ID No: 700348755H1
  unsure 201: a, t, c, g, or other
gggggatcggtcttgttctcggagagggttgagctgcttgacggttttgactccggatcatggtgtgcagctctatcagatagagagctgacgtgaggtgtgagacgcggatcgtggagtactactcagtaggagaggtggggagggggaagaaggcgatagccggggaggatggtgcttgtgcttgcgctgggggatctncacatcccgcaccgggcgcccgacctccccgccaaattcaagtccatgctcgtgcccggcaagatccaacacatcatctg

SEQ ID NO: 4631 - DNA, 280 bp, Zea mays
  misc_feature: Incyte ID No: 700348759H1
  unsure 7, 10-11, 13, 22, 25, 35, 40, 53, 58, 64, 113, 145, 174, 183, 186, 206,: a, t, c, g, or other
atcgcantanngntagacgttnttncccgcttctncagtntagttcaccagcngtcanttctcngctggctgacactgcgaagtgcgaatcaaagccaccaccgcgcacaaancatggcaccggtggaggcggagcagcaccggnggagggcgttggcgctcgcggcgcacgangcctccggngcngtctcccccatccgcatctngcgaagggacactggagatgacgatgttgccatacagatatgtactgcgggatatgcnatctgactngcacacc

SEQ ID NO: 4632 - DNA, 276 bp, Zea mays
  misc_feature: Incyte ID No: 700348761H1
  unsure 219, 222: a, t, c, g, or other
taacaactctcgatctctcggaaaaaggtgaggcccaacacctctgcttcgcaccagtaccacaacgccacgacacgccggcgaggtggacgagcggcggcgatggcgggcggcgaccgggagcgagacgcggacgaggagacgaggaatcagatgatgcagaaccttttcggggaccagtcggaggacgaggacgatgcggacgaggacgacgtcgcnganatggtcgatgaggacgacggccaccaaccgcagtcgcccccgcagtcgcccccg

SEQ ID NO: 4633 - DNA, 280 bp, Zea mays
  misc_feature: Incyte ID No: 700348762H1
  unsure 2, 31, 43, 55, 57, 63, 65-81, 85, 108, 112-113, 124, 205-206: a, t, c, g, or other
gntctctctctttattcgttccccgcctcancccgagccagcngtctcgctatgntnttaacncnnnnnnnnnnnnnnnnnatgnctcgccgtcagctcaggaaggtnctgnnccacgcccacntccccgtgctgctccagtgaggaacccgccacagccagcacgccaggctcctcctccagctcctgttacgagatggtggtnnctgccatgtttggaggattgggtccaccatgctacaaggtatggcgtttggcagggtagtgccatggcacacag

SEQ ID NO: 4634 - DNA, 280 bp, Zea mays
  misc_feature: Incyte ID No: 700348763H1
  unsure 98: a, t, c, g, or other
cgtagccctgcagaagaatcaccaccagagtgttgatgatgatcagaacaagttgctcactgaaaaggatcatgcacatataaataaagaagtgaganaattcactcctcaaacaaaggcccatgctaagattagaaagcctgatgggtctactatcaaggaaaaggtggctccaaatcctaaacctgtaaccaaccttgtgaaggatttttccatgagcccacgagcatcaagtgacagcacagagggcatgccacaaagtgctaaccgatatagagtt

SEQ ID NO: 4635 - DNA, 280 bp, Zea mays
  misc_feature: Incyte ID No: 700348764H1
  unsure 2, 42: a, t, c, g, or other
anccaaagggatcggcttctccgtatggtgaagggtctccgnccaaaactagtgacgttggtggagcaggacgcaaatactaacactaccccattcccttccaggttccgggaggtctatgactactattcggcactttttgattcactggatgccacccttccaagggaaagcccagatagaatgaacgtggagcgccagtgcctcgcagggaaatcgtcaacatcttagcttgtgaaggccctgaccgtgtggaaaggtatgaagtggctgggaaatg

SEQ ID NO: 4636 - DNA, 278 bp, Zea mays
  misc_feature: Incyte ID No: 700348766H1
gtgatgtgatgtgagtattatatgccttaaatctccttatggatggtgtgttgtggctgctgattgtataggaattatcttgttttgtactgtaaagaggtaaacaaccatacaagtgatgatttggttgtttgcggtcagcctaaaaaactttagtaatcaattacttcgtgcttgttaaggttaaacatttggtagggtgcatgtatgtttgtctaaaaattcttaatatatattttgctatggtttgtaaacatactgcagtagaaataagcagt

SEQ ID NO: 4637 - DNA, 276 bp, Zea mays
  misc_feature: Incyte ID No: 700348767H1
  unsure 44, 107, 118, 143: a, t, c, g, or other
gatggggatacccagcgacgacgtggtgcaaatccgccacgccnacgccgctggcgagcccaccgtcgtcaccgtcagctgccccgacaagacgggcctcggctgcnacctctgccgngtcgtcctcctcttccgcctcagcntcgtcaagggagacatgagcacggacgggcggtggtgctacatcgtgctctgggttctgccacgcggggggcggccggtgcccgtgccatgggagctactcaaggacaggttgcttcagtctgccccgtcgcg

SEQ ID NO: 4638 - DNA, 276 bp, Zea mays
  misc_feature: Incyte ID No: 700348769H1
  unsure 25, 64, 262: a, t, c, g, or other
cctacgaatcttccaacccctccgncgatgccttccgcgccggcgctcgtccccgcgtgcgagntgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctcttcccccgacgagcgccacttcatctcccacgtgctcgcnttcttcgccgcctc

SEQ ID NO: 4639 - DNA, 275 bp, Zea mays
  misc_feature: Incyte ID No: 700348770H1
gcgagtattcttttaatggggatttatcaggtgaccaaaacgtcgcatcattttctacagaaaagctcagaaatcgcttgcacgtcgaaggtgttggtgaggcagttattaaagactgtgaacagattattcagtcagaattttcgcagtaccaaacacagatgaagcagcgttgcgaagagtatttgagttttattggcagtcttccacgggaagttgaggtagttaattcagtagattcaactgtccctgagaagtcacagctggaatgttca

SEQ ID NO: 4640 - DNA, 277 bp, Zea mays
  misc_feature: Incyte ID No: 700348772H1
  unsure 21, 64, 76, 220: a, t, c, g, or other
gagagagagagtgaccctacngggcggggagagagccaggaagaggagggcgacgatggcgtcnggctggggcatncaacgggaacaagggccgctgctacgacttctggctggagttcagcgagtgcatgagccgctgccgccagccctccgactgcggcctcctccgcgaggactacctcgagtgcctccaccactccaaggagttccagcgcaggancaggatctacaaggaggagcaacgtcagatcagagctgctgctcgtaaggccaagga

SEQ ID NO: 4641 - DNA, 279 bp, Zea mays
  misc_feature: Incyte ID No: 700348773H1
  unsure 26: a, t, c, g, or other
aggagagacattttcgaggtgtcatngtcctggaggaatgtaacctggaagagatagaggaggaagagatatccgaagagttctaaggattcgaagaaggcaaatggacaagagaaaggcccaagtgcttgtttttaagattactaacagggtttcctacaaaactgtcttaaaagctcacagtgccgttatattgaaggctgagagtatggctgacaaaattgaatggatcaagaagataaaaggtgttattcaaagcagagggggctctgttaaggg

SEQ ID NO: 4642 - DNA, 274 bp, Zea mays
  misc_feature: Incyte ID No: 700348774H1
gcctgacacaatggcaaaatgcactgttgatggcaatctcatcacagcagcgacttataattctcatcccgaattcatcagcctatttgtcaaagcactcggaggttcagtggcaggctcagataagagaatactgttcctatgtggggactacatggaggattatgaggtcatggtcccattccaggctctccaagctcttggctgccatgtcgatgccgtttgccccgacaagggagctggggagacgtgcccgacagccatcatgatttcg

SEQ ID NO: 4643 - DNA, 273 bp, Zea mays
  misc_feature: Incyte ID No: 700348776H1
  unsure 139, 186: a, t, c, g, or other
cgatgattctgaaaggccaagcaagtcaagaacaccaaaaacaatgctaggtgccttgcatgctatctggagcaaggaaggcattccaggcttcttcaaaggcctgaatgctcagatccttaaagcagttctgagctcncccttgctgctgatgataaaggagaagatctggaagttcacttgggnctcgctgcttgccctgcggcggtatcttttcgtttctcagaagaggatcaagagtgtaatgtataaatactagctccaaacatagcg

SEQ ID NO: 4644 - DNA, 273 bp, Zea mays
  misc_feature: Incyte ID No: 700348779H1
  unsure 2, 53, 70, 102, 123, 146: a, t, c, g, or other
gnagcattatcagggagcgtgccgtgggagtgggaggttgcctcaggtgcggngagttcgccggcgggancatcggtgtctgagatgaaggagagaggcggntctagggcggcagtggacgancgctacgcgcagtggaagtcgcnccatccccgttctctacgactggtttgccaaccacaacctcgtttggccatccctctcctgccggtgggggccacagtttgagaaagctacctacaagaatcgtcaacgcctttacctatctgaaca

SEQ ID NO: 4645 - DNA, 274 bp, Zea mays
  misc_feature: Incyte ID No: 700348780H1
  unsure 70, 129: a, t, c, g, or other
cgtggtctggatattaatgatgtgcagcttatcattcagtgtgaacctccccgtgacgttgaagcttacntacaccggtcaggtcggacagggagagcaggtaatactggtgttgctgtcatgctttangagcccagatataagtacagtgtcagcagactagaaagggaatctggggttaagttcgagcatatctctgcaccacaacctactgatgtagcacaatctgctggcagtgaagctgcagatgccatgcgatgtgtcagacagtgtt

SEQ ID NO: 4646 - DNA, 242 bp, Zea mays
  misc_feature: Incyte ID No: 700348782H1
  unsure 74-106, 167: a, t, c, g, or other
gagttgcaagttggtgagatggatctgttggagcggaatattaagacggagacggaggagacgcgcaaggaacnnnnnnnnnnnnnnnnnnnnnnnnnnnnnnnnncggaggcgggggagaggaagacccaggagccgccgcagcaaggccagggcctcagcctctncactcgccaacggcagtggcaggtctggaatgttgccgatgtcgaacgtgtccgctaatccttcacagcttacaa

SEQ ID NO: 4647 - DNA, 269 bp, Zea mays
  misc_feature: Incyte ID No: 700348784H1
  unsure 2, 18, 42, 45-46, 175-176: a, t, c, g, or other
gngaagttcttacccaanacctggagggtcactatctcagantcnngtacagtcaggaagtggttctttgggatcttctggaatgctatatgaaggaagctcgggtgacaatgctccatttgatattaatgactttcctcagttaactggacgacctaattctgctggaggtggnnaaggactatatggatcattgagaaagcatggagtaagcgtcaatgccattgtacaacaaaaccaggaattcagcattcagaatgaagattttc

SEQ ID NO: 4648 - DNA, 267 bp, Zea mays
  misc_feature: Incyte ID No: 700348785H1
  unsure 62: a, t, c, g, or other
tcctcccgacgccgtctccctccctccctccgcctccgccgtcgccgccgggacacgcgaanttccaaggtcttgtctttgggtagaacatgtcgtgctttgcgtgctgtggtgatgaagatacccaagtaccagacaccagggctcaatacccaggacaccatccagcgagggccgatgcataccgcccttctgatcaacctcccaagggtcctcagcctgtgaaaatgcaaccaatcgcagtcctgctattcctgtggatgagat

SEQ ID NO: 4649 - DNA, 269 bp, Zea mays
  misc_feature: Incyte ID No: 700348787H1
gtcatactgaattttggaaagtccgtagcaagaaagcacatcccagctgaaagtgcctggtctactccattaacacctcctatgccctggggtcagtcatcaaggccagttaacggctcccgccatccccaaagtcctaaacactatgggtatgctccaatcagcggtgtacttccagcaccaccagttggagctcatcacgtcccaccgtctgatgggatgcagccactatttgtagcccctgctcctatttctgctgcagccatacc

SEQ ID NO: 4650 - DNA, 266 bp, Zea mays
  misc_feature: Incyte ID No: 700348792H1
  unsure 18, 53, 77-79, 147-148, 221, 227, 230, 235-236, 241: a, t, c, g, or other
accagatatgagtttggntacagtgcgaacatatatatggaagaagccggaanatttgattcttcattatagagtgnnnccaatcgagatgatcacggcttcagatgtacatgctcacatggttctccagatatgtcccagcatgtnngcacctttagatggtgtggttgaagatgcctttggcttagagaggaagcatcatcttcacagaggaaatattntgctcntgntccgnnctccncccggtagctgttcccagaatcgac

SEQ ID NO: 4651 - DNA, 263 bp, Zea mays
  misc_feature: Incyte ID No: 700348794H1
  unsure 105: a, t, c, g, or other
gagaagtgtcgatggaggccggggcctagcggaggccgttgggaatgttgatgccggagggaggatgagagggatgcagattctagcggcggtgacgcttcgggnaaggttttcgtagggggtgtagcctgggagacaactgaagaaacattcacaaagcattttcagaagtatggagctataactgattctgtgatcatgaaggacaagcatactaggatgcctcgtggatttggatttgttacattttccgatccgtctgt

SEQ ID NO: 4652 - DNA, 264 bp, Zea mays
  misc_feature: Incyte ID No: 700348795H1
gggaatgcagggcctaaactttgacggcgatgacagggttcactattagcatctccatctctttgggaccttggcagggagggtgcattgcgtcaaggcccctcgccgacatggcctatgtaccacgggcggctagacaataaagatgtctgggtgagtgagcctgagcatagacaatggctatgctgctttagcctcccttcccttgtacaggtttgccatttgtttggttgcgcggcgtcctgtgtatttgagttgagatca

SEQ ID NO: 4653 - DNA, 329 bp, Zea mays
  misc_feature: Incyte ID No: 700348801H1
gccgcgaccgccccaacccaactgcccttttcggagatctcgccgcctccgccgtcgacttccgtcgcccccctatcccgcgtccgggttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaattagggtattgatcaactcaaattttctggatgttgacgaact

SEQ ID NO: 4654 - DNA, 255 bp, Zea mays
  misc_feature: Incyte ID No: 700348802H1
  unsure 56: a, t, c, g, or other
cggcgtgccactactcgccgtcgcttgtggcagaggagcagcttcacggctccaancacaccttgaccttgaagggcgagaacggcttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaattattagcag

SEQ ID NO: 4655 - DNA, 324 bp, Zea mays
  misc_feature: Incyte ID No: 700348803H1
  unsure 45, 60, 76, 147, 229-230, 242, 258, 280, 297, 309: a, t, c, g, or other
cttccctccgtctcccagctcgcgcaggcaggcgacacagcgacnctaaaaaccctagancgaggaggcgtgccangccagcggtttgcgatgacggcaccggcggacaaggggaagaaggccaagaccgatgccgacggcggcgangagaacgagcaaatcgacggcgcccttgtcttctccatcgagaagctccaggagattcaggacgagctcgagaaggttaatnnggaagcaagtgncaaggttatggaggtngagcagaaatacatgagattcncagacctgtctatctcnagaggggtgacntatcaagaccatccc

SEQ ID NO: 4656 - DNA, 96 bp, Zea mays
  misc_feature: Incyte ID No: 700348805H1
  unsure 79-80, 82, 84-85, 92, 94-95: a, t, c, g, or other
ccgggctgtttattcgcatcaggaggcgcgggtggctcgcagagggcgagaagacccttcccgcttccacacaacatannancnngcccccntnng

SEQ ID NO: 4657 - DNA, 321 bp, Zea mays
  misc_feature: Incyte ID No: 700348806H1
  unsure 5, 13, 18, 57: a, t, c, g, or other
aaganagaaaganaaggncgcaggaagaaatcgagcctcacttcgatccatcgcctncgccgcagcacacacgagggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctga

SEQ ID NO: 4658 - DNA, 313 bp, Zea mays
  misc_feature: Incyte ID No: 700348808H1
  unsure 93: a, t, c, g, or other
ctggaaagttacggaagagtggatgagcttgtgtactttgccggtttgaaggagcagtatgaaattgtagttcatcattacattcagcaaggngaagcaagaaaagcattggaagtgcttcaacggcgcaatgttcctgtagaccttgtgtataaatttgctccagatttgatcatgttagatgcttatgagactgttgaatcatggatgatggcgagaaacaggttgaatccagggaaactcataccagcaatgatgcgttatgtgagcgaaccacatgcaaagaatgaaacacatgaagttatcaaatact

SEQ ID NO: 4659 - DNA, 309 bp, Zea mays
  misc_feature: Incyte ID No: 700348809H1
  unsure 39, 127: a, t, c, g, or other
gggatttctttgtcacactgcatggcatattagctgagnaggaagaagttgctgagttgcaacctgtacctgatgctcatgtacctgtattgaaatttaagttccgtgggatatcaattgaccttcnctatgctagcatctctctttcagtgataccagcggatttcgatatttctcaaggatctgtactttgtgatgttgacgaagcaactgtgcgaagtcttaatggttgcagagtggcggatcagatcttcggcttgttccaaatgttgagaattccggacaacactcagatgcttgaagtactgg

SEQ ID NO: 4660 - DNA, 310 bp, Zea mays
  misc_feature: Incyte ID No: 700348810H1
  unsure 197: a, t, c, g, or other
gcctgctgcacccgcacttccgctacaccatggagatcaacgcgctggccagggaggcgctcatcaacgccgacggcattcattcgaggagtccttctggccgggcaagtacgccgtcgagctcagctccgtggcgtacggcgcgacgtggcagttcgacacggaggcgctgcccaacgacctcatcaagcgcgggntggccgtgcgcggggaggacggggagctggagctcaccatcaaggactaccccttacgcccacgacgggctcctggtctgggactccatcaggcatgggcgtccgagtagtca

SEQ ID NO: 4661 - DNA, 306 bp, Zea mays
  misc_feature: Incyte ID No: 700348811H1
  unsure 41: a, t, c, g, or other
gggaaccttggatgtgccagaaccaacatggtttattctangtggacatcgcctgctgagaaaagagtatagggctatacttagacgtttgagaggtagagtttgcagggattcacatcactggtctttccaagcaacacaccttgtcaccactgagatgcgcagaactgaaaaattcttcgcagctgctgcggctggcaggtggatactgaagcctgattacttgactgctagcaatgaggctggcaagttctcagaggaagagccattgagtggcacggtgaaggcctaatatcggtgatacga

SEQ ID NO: 4662 - DNA, 311 bp, Zea mays
  misc_feature: Incyte ID No: 700348812H1
  unsure 6, 8-9, 149: a, t, c, g, or other
ccggangnnagctcgcggaccgtgaaccgggccataatggctgagctggtccgcctctaccgctcgtcccgacctggggatgcggctcccggcctacgacggccgcaagaatctctacaccgccgggaccctcccgttcgacgctcgcnagttcgtcgtgcggctcaccgatgaggacgacggcaccggcgtcccgcctcgggagagggagtacagggtcgccatcaagttcgccgcgcgcgccgacctccaccacctcaggcagttcatcgccggacggcaggcggacgcgccgcaggaagcctacagta

SEQ ID NO: 4663 - DNA, 313 bp, Zea mays
  misc_feature: Incyte ID No: 700348814H1
  unsure 8, 47, 152-153, 155: a, t, c, g, or other
ctaccgcngccgccgccctacgttagataccgaggccttcgccgacnacgaacacccgccagggatggcgaccacagcactgcttccgggctctccggcggccctcatccgaagccgcgctgcgattggctacaaaggcaaatgtgcaaacnncnaatggatatagacatctgaataacaggaacctaagcgttttcaatgagttttctaagcaactaaagggtgaggccaagagcaatcctgaattcccagaaatccatgaaggagttcagcgagaaacttgatgtggtgaaggaagatctcaaagtaagaa

SEQ ID NO: 4664 - DNA, 122 bp, Zea mays
  misc_feature: Incyte ID No: 700348816H1
  unsure 101, 107, 117: a, t, c, g, or other
acttactgagcacctgctgtgtgcagggagctgagctatgggatgggaatgggagtaaacaaggtacttttcacttttttctttttttcctcactgctagncgggcngggaacttcncactc

SEQ ID NO: 4665 - DNA, 321 bp, Zea mays
  misc_feature: Incyte ID No: 700348817H1
  unsure 50, 71, 304: a, t, c, g, or other
cgtccccaatcgtcgccgggagtctcccgatccttcttccaccacctcancggtggtgtcagggccggctncgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatggggccagcatatatccgagttttcctgaatatctgcgganatctccaaggaagagat

SEQ ID NO: 4666 - DNA, 312 bp, Zea mays
  misc_feature: Incyte ID No: 700348819H1
  unsure 125-126: a, t, c, g, or other
gtatgcatagtgaggacaatctggtgactatatttatttgctcatgattggatttctagcctcacaagatcagcagcttgtatggtaaattcactggcagttaagttactcttggtcaacttganncctgaagcatgcatatgaggcaactatggtagaccattttggtagtcaaggttgaaaatcatgtataatgatctggttgggaccacttatcttgccacatgttcagggcagtctgcctcgtcctggaagaacatctacaggacaatccttgcagcacggttgtttcaccacactggatatgctccg

SEQ ID NO: 4667 - DNA, 309 bp, Zea mays
  misc_feature: Incyte ID No: 700348820H1
  unsure 206: a, t, c, g, or other
gggccggcatcatccgtctcgtctcgtctcgcctctcctctccttttcccccctccctgcacagcgccgctcaccgtcaccggaccacagcagcgatcgatggctgaggtacacaacgagcggcccgtggggatggtgggcggcgtccgggacgcgccggtgggccgcgagaacgacctcgaggccatcgagctcgcgcgcttcgngtcgccgagcacaacagcaagaccaacgcgatgctggaattcgagaggctggtgaaggtgaggcataggtcgtggccgggacctgcaccattcaccgtcgagt

SEQ ID NO: 4668 - DNA, 309 bp, Zea mays
  misc_feature: Incyte ID No: 700348823H1
  unsure 9, 148: a, t, c, g, or other
gaggttctnggtgacaaagttgagaaggtggtggtgtctgatcgcgttgtggactcaccgtgctgccttgtgactggcgagtatggtctggaccgccaacatggagaggatcatgaaggcacaagccctgagggactcgagcatggcncgctacatgtcgagcaaaaagacaatggagatcaacccagagaaccctatcatggatgagctccgcaagcgtgccgaggctgacaagaatgacaagttcagttcaaggatctcgtgatgctgctgttcgagatgctctcctgacctccggcttcagcctgg

SEQ ID NO: 4669 - DNA, 303 bp, Zea mays
  misc_feature: Incyte ID No: 700348825H1
acagaagcggcggcggcggagcaaacgcaggcgaaggcgagggtgtgagggaaggagcaccagccatggtgcacgtccaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcattcttc

SEQ ID NO: 4670 - DNA, 300 bp, Zea mays
  misc_feature: Incyte ID No: 700348827H1
ccagaaatacgtacgacatgccgtggcctttgaaggtatttctcctgatgtgcctctctataaagtcaatgaagggaatgaaccttgcttcttcaggacatacttctcctgggatagcgcacgatccgtgattcatggaaactcttttgagaagaaactttcagttcttttcggaatgcgttcagagggtggcaataagggctcaggtgatggtgggccaactcaaaggggcatcagccttggccgctctttcatctgcatgaatccatcgtcgcaaggaaaacagtcagatgagaagcc

SEQ ID NO: 4671 - DNA, 109 bp, Zea mays
  misc_feature: Incyte ID No: 700348830H1
  unsure 50: a, t, c, g, or other
ggagttgaactcggataagctctcacagcccatctgatgtccaacaattnctgatgccctagcagctagcagtggaacgttccacctccttgaattcccaaagccggca

SEQ ID NO: 4672 - DNA, 91 bp, Zea mays
  misc_feature: Incyte ID No: 700348831H1
  unsure 2: a, t, c, g, or other
ancacaccaaaccgtttcacccggacctgcccccaacaccctgctctatcctcatagcaaaccaccgcctgaattgggcggcaattgggag

SEQ ID NO: 4673 - DNA, 305 bp, Zea mays
  misc_feature: Incyte ID No: 700348834H1
gtgaccatgggagggaattggagctaattgacgatggcaagaatgaagaaacgcctctgtcagttcttcaggtaaatgctatgagaaagttggggtcggtggaagaggtgcctgtcccgctcttcccgtccaagggtcttcggttgaagcaaaagattaaggactggttggaagggttccagaggctccctatgtatctccatatgagaattcagccacatcaatccgggtagtgatgtttcagagaagcgggcatcggggtgctccatgagctgcttagtctgtttgtgacatgctctgctgag

SEQ ID NO: 4674 - DNA, 101 bp, Zea mays
  misc_feature: Incyte ID No: 700348835H1
  unsure 27: a, t, c, g, or other
cggacgcggccagtcaggtgctcctgngctccggtctcaccatcctgtcccagccgctcatgtacgtgaaagtgctcatccaggtgggatatgagcctctt

SEQ ID NO: 4675 - DNA, 302 bp, Zea mays
  misc_feature: Incyte ID No: 700348836H1
  unsure 69, 91, 241: a, t, c, g, or other
cgacaagatctggaacaacgggcccatcagcttccagctggagtggttccagcaggtcgcgtccgccgnctgcggcggggggcaggcgcanagggccgactgcaagagctacctggccaactccctgttcgtgttcggcgagttcggcggcaacgactacaacgccatgctgttcggcaactacagcgcggaccaggccagcacgtacacgccgcagttcgtggccgccgtcgccagcggntcgagaagctggtggccatgggcgccaccgacatcgtggtgcccggcgtgctccccatcgg

SEQ ID NO: 4676 - DNA, 302 bp, Zea mays
  misc_feature: Incyte ID No: 700348837H1
gtactatgctactagggctgcactaggtcttacattccaatggagctcccctgttgctttcattacatgcttcgtgacactatttgctttggtcattgctataaccaaagatctccctgatgttgaaggagatcgcaagtatcaaatatcaactttggcaacaaagcttggtgtcagaaatattgcattccttggatctggtttattattagcaaactatattgctgctattgctgtagcttttaccatgcctcaggctttcaggtgcactgtaatggttcctgtgcatgctgtccttgctg

SEQ ID NO: 4677 - DNA, 300 bp, Zea mays
  misc_feature: Incyte ID No: 700348838H1
actgagataacccatctacagcagcaaattgatgaagctaaacttcggaaatcaaagctagagaagaaactgaaacagaggggcctacttaacagggagtcagaggaatctgacgaagaagagaactacttttccattgaattgacaccaagtttgtttacatctgccgtcgataatgcctaccagtcgatacatgacttctcaaagccttgatcaacatgatgaaggctgcaggttgggatctgatggggctgctagtgcgatcgagcctggtgtggtttacacaagaagggctcacaa

SEQ ID NO: 4678 - DNA, 299 bp, Zea mays
  misc_feature: Incyte ID No: 700348839H1
  unsure 73, 76, 79, 83, 85, 296-297: a, t, c, g, or other
aaagctgccaagaaggagaggctcttgaagagggcccaggctgaaaacgaggggaaaactgttgagtcaaagnatnccnttgngntgtgaagtacggccttaaccatgtgacttacctcatcgagcagagcaaggcccagctggttgtcatagctcatgatgttgatccgatcgagctggtcgtgtggctcccggccctttgcaggaaaatggaggttccatactgcatgtcaagggaaaagcacgccttggatcgatcgttcacaagaagactgcatctgttcttgcttgaccanncc

SEQ ID NO: 4679 - DNA, 291 bp, Zea mays
  misc_feature: Incyte ID No: 700348842H1
  unsure 2, 6, 12, 20-21, 23, 26, 33, 72-73, 81-82, 156, 166-167, 180, 214, 235,: a, t, c, g, or other
tnatancatctnaacatatnntncgntgagganaggtcgcactattatgatgctctattcagcagctgattnngggctgannaagcaaagaaaggagtgcattctcaaaaagaatctcctgtgatgcatataacagatttaacaactgtatctgcnaagaaggccnnagattccttcccnaacttgcagaggaacagaaggcattctgccgttnttgaatatgtttttagtggcnatcnnntgccaactaacattctaaggagacttgcatattgcctctcatatctggtg

SEQ ID NO: 4680 - DNA, 297 bp, Zea mays
  misc_feature: Incyte ID No: 700348849H1
  unsure 195-196, 199, 203, 216, 243, 252, 256, 259, 262, 264, 268, 277-278, 289: a, t, c, g, or other
ccaattcgctgggattccctgtggaaaggcgccgctttggttcctgtttccccacagctcccaactctctatatctgcaatctcttgttcatctaccgtttcttgctttgacgcaaaccagatcaatctgtggccgttgtttccatcggagctgttgaggtttgtattcttctcggccgaagacatggcggcggnnaangganctgcgttgcgtgngtttcagcgaggaggactgagggaganagtggggtncgcnggnganancatncgggagttnncttcgaaaacnccacccac

SEQ ID NO: 4681 - DNA, 297 bp, Zea mays
  misc_feature: Incyte ID No: 700348851H1
  unsure 102, 214, 295: a, t, c, g, or other
gtccaagctcctccagttagaatcgacagccaagcaaaatatggtgctctggcccgaggtgatggcgccatttacttgcgctttccacacaaaggttatagncgagaaaatatgggaccatgcagcaggctcaattgtcgtgacagaagctggaggcatagtgacagatgctgcgggaaacgacttggatttctccaaagggagatttcctcgntctcgacacaggcatcatcgcaaccaacaaggagttgatgccgtcgctctgaaaactgtccagaggtattaaagagacgancc

SEQ ID NO: 4682 - DNA, 292 bp, Zea mays
  misc_feature: Incyte ID No: 700348854H1
gggcacaaaggatggcagcgccaaggttggtggaaaggatggcgccaaagaaggcggcgcggcagccccagcaaacggcgccaagcagcctgctgagagccaagaaaccaccgccaatggcccctcggaggcggagaaagagcagcctgcagcctctgagtgaccggaaagggtgtctttattaagacatacaccagagccttaactgtcatagatggaagcgtgttttatttcagataatttccagacccgtctttcccgcgctgctgatcttttgtagaggagatctgct

SEQ ID NO: 4683 - DNA, 277 bp, Zea mays
  misc_feature: Incyte ID No: 700348855H1
  unsure 21, 56, 99, 136, 161, 178, 182, 188, 195, 202, 206-207, 209, 220, 223,: a, t, c, g, or other
attgatggctctacttatgcntttgtacttgtcgatagatggcctagattatgtcnaggatgaaagtattgaccaaattttggttccaagaatgaaganaatgccaataaagatgtttagatccatcagacatacnaaggacttcgatgtctcctctcaantatgacaagcttatgantgcntcaggnttccatnacacaanttcnncngtatccgtatnagncgnnngntgccntgaaaangtgcaancngnntntattgcnccancaagnantct

SEQ ID NO: 4684 - DNA, 294 bp, Zea mays
  misc_feature: Incyte ID No: 700348858H1
  unsure 185, 272, 275, 281, 283, 288: a, t, c, g, or other
aggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcntctcggagtaccggtacgacacgacggagctggtgcacgaggccaaggacggcgcctcccgctgggtcgtccgccccaatccgtaantanaattcngnacaanaacggc

SEQ ID NO: 4685 - DNA, 284 bp, Zea mays
  misc_feature: Incyte ID No: 700348860H1
  unsure 211, 234: a, t, c, g, or other
acggcccttccctcaccgccccgcgcgaggaaatcatgaagcttgaggtcatgcccaagcagcgggtgctggaggcggagagagggaggaggccatggagatgagtggcctggacctgtggaagcacgagaagcccccaaggatctgccccttgcccccgtcgctcccggcgccgccagcgtgcgacgaggcggcgtcgtgccgccgctcnaacttcgccatggtcgacgaggntattcctctcggttcccggagaccgccatttcggttctcaagtcctcaac

SEQ ID NO: 4686 - DNA, 287 bp, Zea mays
  misc_feature: Incyte ID No: 700348862H1
ggttcttcgtcagttgcgcggtacttgaaaagcatcactcattcgaacgggcaacaagaatttccgggtgtgggtggacagactggtcacatcgccgatcggtacaagcaactggttggtgaggtttgataactgggagatggaaggtggcgttcggtactgctgccgcactatcttctgctgaataacaaggttccaaaagaactagaatacagattggttgaattcaaacaaatacaaagagctatgcatacaatggtggaggcctggtggtaattgtttatcag

SEQ ID NO: 4687 - DNA, 300 bp, Zea mays
  misc_feature: Incyte ID No: 700348864H1
  unsure 232, 234-235, 239-240, 244, 255, 270, 276-277: a, t, c, g, or other
gattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgccngnngtannaaancgtctctgggntgtagctcaaagatnccctgnnaaggctgttggtgtaaatctccc

SEQ ID NO: 4688 - DNA, 298 bp, Zea mays
  misc_feature: Incyte ID No: 700348865H1
  unsure 189, 224, 227, 231, 238, 251, 257-258, 262, 267, 272, 290-291: a, t, c, g, or other
gtgaccctccctcagccgcgtcgcgttcgcatcctacgatccaaagctctctctgctcgcagccatggcgaagaactacccgaccgtgagcgccgagtacagcgaggctgtggagaaggccaggcgcaagtccgagccctcatcgccgagaagagctgcgccccgcttcatgctccgccttcgcgtggnactccgcggggagttcgaccgtgtcttcgagaacnggnggtntttcggnagatgaaccttcngtggannttgncccanggctnaacgggggttgaaaatcnngttccgc

SEQ ID NO: 4689 - DNA, 296 bp, Zea mays
  misc_feature: Incyte ID No: 700348866H1
  unsure 108, 161, 168, 173, 182, 188-189, 191, 193, 203, 211, 284, 288-289: a, t, c, g, or other
ctgccctgcccccaccgccccgcttccttccgccttgctccgttgcttcctcccaccacagtccactccactcgccggccctgcagctcagtatttgactgagactgntggtggagctgctagcagcgagcctgctacttcctggtcctgacggtgcgttnagacctnagacnagtgccgangacganntntnaggagagggnaaggaaanaagcctgtgaggaaggcggcgatggagaggtacgaggtgatcaaggacataggatcgggaaattcggggtggncaanntggtccg

SEQ ID NO: 4690 - DNA, 295 bp, Zea mays
  misc_feature: Incyte ID No: 700348868H1
  unsure 79, 152, 186, 218, 229, 240, 245, 260, 274, 278, 284-286: a, t, c, g, or other
gggagaccccagaaagagtccgtaaacaactcccggccatggcgaccgcagaccgggtcgccgccaccttcctctcctnctttccccactcaccatccccgccccttttcctccgtttccctcgtgacaaaccctgtcctacccgtctcccntcgggccgctgtcacaggtggcccacggctcgcntcccgtctccgggtccaccgcgtcggcgccgncgtcggcccangtttccaacangaatnggagtagcttcttgnggggagaagatcanaagnggtcannnggggtgtgc

SEQ ID NO: 4691 - DNA, 288 bp, Zea mays
  misc_feature: Incyte ID No: 700348869H1
  unsure 202-203, 206, 216, 221, 229, 243, 284: a, t, c, g, or other
gtagaatcgaaactttttttcaagcaagcaacaagttggcgaccctctgcagccagcgatcttatgatctcagtatcatccgaactgtctttacggaatcctagtcttggtgctcgtgttcctcaactccccgtgcaggttattgcagtatctcctcacttatattatggaaattctccaatttatcactatgataaggtannacnatcccggagntactnacactcgnagctactaatatgncatccgaaaacttacattaactgtcctgctcctgaagatcnggtt

SEQ ID NO: 4692 - DNA, 290 bp, Zea mays
  misc_feature: Incyte ID No: 700348872H1
  unsure 16-17, 27, 47-48, 51-56, 58, 60, 114, 116, 123: a, t, c, g, or other
cttgatgcagagatgnngggaggctantccgactgatcgacctcacnntannnnnncncnttcctgaactagaggatatccaggcacaagcacagagaacatcaggggaaacgngnccagacncaggaggaccactcatgcagtaaagattgattgaccccctctgtacatacatgttgacaattctctcatctgatcactaaaatgctgagaaagtagcatatcatcagttttgatgccatagaaaaaaagtagcgaatcattttgtcagttttgtcagaacgctttgg

SEQ ID NO: 4693 - DNA, 290 bp, Zea mays
  misc_feature: Incyte ID No: 700348875H1
  unsure 97, 107-108, 123, 190, 258: a, t, c, g, or other
tgcatctacccattgatcctctcttcaggcttggatccatccctgcaggctctggacccaggactaagacataaggaagaggctagcttctcatcantcctcagtcnngtctgatggcaggcngcaaggttgctgtgctcgtttcccctagccagcctttgacacagtccttcctcaccgtcactgggcnagcgtccacactcagaacccttcatgggcacagccacaccaatccatagagcggaagttctggagtcntcagcccttccacgtctttcactcagctagga

SEQ ID NO: 4694 - DNA, 288 bp, Zea mays
  misc_feature: Incyte ID No: 700348876H1
  unsure 91: a, t, c, g, or other
ctgggagttgtgatccttatgttgaggtgaaactaggaaattataagggccagactgggcatttcgagaagaagaacaacccggagtggantcaggtctttgcctttgcaaaggagcgcatccagtcatcagttgtggagattctggtcaaggacaaggatcttgtcaaggatgacttcattggacgtgttatatttgatttgaatgaggtcccaaagagagtgccacctgatagcccattggctccacaatggtatcggttggaagaccgcaatgggcacaaggtga

SEQ ID NO: 4695 - DNA, 186 bp, Zea mays
  misc_feature: Incyte ID No: 700348877H1
cagaatggcaacagttcctgtaaagtctgaacctgcacatcttcttttttgtatgtatattgcccggggaggtgggaggtctgtaccctggctggtcgaatttcagtatgtgctttgctgatatgtactgtatgctagaagatgctttttatcttagataaaacgggaataaaaggcggattgggc

SEQ ID NO: 4696 - DNA, 286 bp, Zea mays
  misc_feature: Incyte ID No: 700348878H1
  unsure 91-92, 182, 252: a, t, c, g, or other
tgcagatcagcaacttcgccagcatctggttcatctccctcttcatctcgatcttcgccacgggcatcctggagatgaggtggagcggggnncgcatcgacgagtggtggaggaacgagcagttctgggtgatcgggggcatctccgcgcacctcttcgccgtgttccagggcctgctcaangtgctggccggcatcgacaccaacttcaccgtcacctccaaggctcggacgaggacggcgattcgcggantgtaacatgttcaagtggacgaccctcctaatcc

SEQ ID NO: 4697 - DNA, 288 bp, Zea mays
  misc_feature: Incyte ID No: 700348881H1
  unsure 226, 257, 275, 281: a, t, c, g, or other
ggctggtcaacttcggttggtgagagcggaaagcttgtggatgttgggtggccatctgtctgggtcaggattgcaacccagtgggcgacggcaggtctgttcatatggtcgcttgttgcacccatcctctttcccgacagggaattctaagttcaaccacggtaagcctggagcatcaaacgtgtctactgtggtagctaatatatcctatcaagtatgttgcttnaaaacatgctccgagcgtggatggcaaaaantcggtgtttgcccatgtnaatcangtttgtc

SEQ ID NO: 4698 - DNA, 169 bp, Zea mays
  misc_feature: Incyte ID No: 700348882H1
  unsure 3-5, 10, 14, 20, 74-75, 90, 113, 119, 131, 136, 163: a, t, c, g, or other
gtnnngcaanaatnagcatncccacagtagaattgtacaagacattacaaactaaacttcaggcattgctaganncatgtattgtacaantctactgtgggaatgctaattantgcggnacagttgtattngcacnaagaaaccacagtttgaattatacaanacatta

SEQ ID NO: 4699 - DNA, 136 bp, Zea mays
  misc_feature: Incyte ID No: 700348883H1
  unsure 3, 28, 48, 51, 53, 55, 57, 81, 118, 129, 134: a, t, c, g, or other
gangcctccgctccttaatgtgaaactnccatgaagttttaaacttcntgnantncngaaattccatataagtttttatcngcaagttacagcttgtgtggtttgtctttggaaatanaaatccaggtnctctnag

SEQ ID NO: 4700 - DNA, 284 bp, Zea mays
  misc_feature: Incyte ID No: 700348885H1
  unsure 179, 194, 201, 203: a, t, c, g, or other
aattttatcttctatatcaacagtgttaccagatttgacattctatattatttcttaccgctcgtgagcacgtgaacgcatagacataggaatcagcacagtgcatagaggatcaccatacaccctctatacatagcggacgcatgccattctctaaattttagtggaccttttagagncccttgttggagggntaaaggncntgacaaacctctatattagagtactaatcttttacaggttcctgccggagccagtcttaggcagcgatcctactgatcgac

SEQ ID NO: 4701 - DNA, 92 bp, Zea mays
  misc_feature: Incyte ID No: 700348887H1
  unsure 88, 90: a, t, c, g, or other
cctaccgctccaagcccagccctcagccatggcatgccccctggattcaggccattggcttccttcgtggccatcttccacacaacananga

SEQ ID NO: 4702 - DNA, 285 bp, Zea mays
  misc_feature: Incyte ID No: 700348888H1
  unsure 49: a, t, c, g, or other
gcgagcgaagaggcggctccggcgagtgcgcggcaaggacgaaggcgtncggggccagtggcgagaggaagagcatgctgaagttcctgtccaaggtggtggtggagtactgccctctggacccgcggaaggcggcggcagtggagctcctcgcgcagtgcaacggccgcaaggcaagggactccaacccggcttgctcggtcgagctccgccgcctcccctccccagctccgtccacggacctcaagtcgcagccgactctccggcttcgaaggttcttgtgac

SEQ ID NO: 4703 - DNA, 283 bp, Zea mays
  misc_feature: Incyte ID No: 700348889H1
  unsure 2, 17, 30, 45, 65: a, t, c, g, or other
cnccggccacgcacttncccgccccccgancccgcaacctctcgncgccggtccccgccctccgnccctccacgcgcaaatagcccgcctccatccactaggaggatccccgatcagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaatgtttttaatgtgaagaa

SEQ ID NO: 4704 - DNA, 287 bp, Zea mays
  misc_feature: Incyte ID No: 700348890H1
  unsure 8, 40, 43, 158: a, t, c, g, or other
cgaccggnccgggcgacgcggccggcaccaccaacaggtncgncgaggatgagctcaacatcttcgacgcagacttcgtcaatgtagagcactccaccctcttggacctcatcctggctgcaaactacctggacatcaaggggctcctgaacctggcncgccaaaccattacagaattgatcaatgggaagatgcctgaggaggtctgcaagaccaacatcaagaacgacttgaccatcccttccacgtcggccttggccaccacaatgccctcctccgagcgaaag

SEQ ID NO: 4705 - DNA, 96 bp, Zea mays
  misc_feature: Incyte ID No: 700348894H1
  unsure 55, 83, 85-88, 90, 92-93, 95: a, t, c, g, or other
tctaaacaatccaattattttttacttctacttatgttatatttttacttctaanatttgttaaaggttccacacaacatacnannnncntnntnt

SEQ ID NO: 4706 - DNA, 190 bp, Zea mays
  misc_feature: Incyte ID No: 700348895H1
ccaaaactagtaccagcagcgtccccagttggtgtggcaaatgggaataatgagatgaaagaatcaaacggcagtttcaagtgaatccaatagccatgtaaaattctgaaggtgtcaattctcagcaaagcgagcaaagtgcaaagcagcgttcaaagaaatccagtgatggtgtgtgcggaaaagaaga

SEQ ID NO: 4707 - DNA, 156 bp, Zea mays
  misc_feature: Incyte ID No: 700348896H1
ggcgccactcccgccgctcccttcagcgccttcagcgccctcggcgaggagggcgaggaccaggatgaggaggaccccgccccgtctgccgcagccgagccggaggccatcaacgatccggcggaggacgacgatgacgtctcgatttcgatttca

SEQ ID NO: 4708 - DNA, 300 bp, Zea mays
  misc_feature: Incyte ID No: 700348901H1
  unsure 25: a, t, c, g, or other
gcctctagaagcaatcaggcgagcngcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaatgtggtatgcctgtccttgctgtcaacaatgtttttgagagtgagatggccaatttcaggaaggttgaaccgg

SEQ ID NO: 4709 - DNA, 182 bp, Zea mays
  misc_feature: Incyte ID No: 700348907H1
  unsure 7-9, 15, 31, 48, 64, 70, 79, 82, 86, 102, 117, 119, 170: a, t, c, g, or other
atatcannnaacgantccaaatccgctcgtntcccctcgaagtatttncctccagcactgcgcnggctcngcgtcctcnggntctnccacccgagccgagancacccatccaagcgngnacagttccggaagcgacagggccggacgagcgcctcccaaatttagcagcngcggaggcgtgg

SEQ ID NO: 4710 - DNA, 290 bp, Zea mays
  misc_feature: Incyte ID No: 700348908H1
  unsure 67, 116, 119, 249, 251-252, 273: a, t, c, g, or other
cggagctcgaccgaacgccgctcaccatgatcatccccaagaagaaccgcaatgagatctgcaagtncctcttcaaggagggcgtgctgtatgccaagaaggactacaacctggcncanacccgcagatcgatgtgcccaacctccaggtgatcaagctcatgcagagtttaagtccaaggagtatgttagggagacttctctggcagtactatactggtatctcacaacgatggcattgagcaactangnnataactgaacttccgtctganatgtgctgcaagctcag

SEQ ID NO: 4711 - DNA, 178 bp, Zea mays
  misc_feature: Incyte ID No: 700348910H1
  unsure 132, 173: a, t, c, g, or other
gaattgtatactcagcacgtgcttataagataccagaatgtactagaactgctactgggactccgttggtacagttgctacctttatctgatggagagcggataacctccatcattcctgtgagtgcatttngtgagaaccaatatctagtgatgctcaccgtaatggctatntcaag

SEQ ID NO: 4712 - DNA, 179 bp, Zea mays
  misc_feature: Incyte ID No: 700348912H1
  unsure 32, 172, 174: a, t, c, g, or other
gctgcagcttctgcatacacacactgcaagtntccatgtccggcgccacctgagtcctgagcctgctctctccgtctctctctccctactcttcccctcgaccttccgtctccttggcctttttattcaccgcagccgcagcacccgtgcactaccacacaaacagacacanangtgac

SEQ ID NO: 4713 - DNA, 298 bp, Zea mays
  misc_feature: Incyte ID No: 700348913H1
  unsure 259, 269, 288: a, t, c, g, or other
ccggagcagccgcagtcccaccgaccccgccgccggtcgccctccatctcctcgccgctgcctctacgtttctcttttcaataatcaagatgagccgtggtggtagtgccggtggtggtcaaagttctctgggttatctctttggaagcggtgagccccccaaaccagcagtggcaccagctgcaagtgctccacctgttgagaaacatctgctgcaaagactgatgcggccaagcagttgctgctggggttaccagcnaaaccataantacaacagggctgatggtnagaacactgg

SEQ ID NO: 4714 - DNA, 293 bp, Zea mays
  misc_feature: Incyte ID No: 700348915H1
  unsure 280, 292: a, t, c, g, or other
aggcctatcatgctgaagttgtcagatgtgtcattgcattcttttctgatgatggtgctaaccttggcagtgatccatcagtaccactgaaaggcattccatgcagcatttctgaagctgttgatgggattcctagttcaagtcggaaggcatggataccattaccttagagggacttccagttttagacaaaacactcttcctaccacaagcacaggagcccatctgtgcctagaaaatctggtgaagctgagttcagacaattgatataagctgccangatgaatggatng

SEQ ID NO: 4715 - DNA, 299 bp, Zea mays
  misc_feature: Incyte ID No: 700348916H1
  unsure 57, 154, 201, 214, 249, 253: a, t, c, g, or other
ccagccgccaccaggtgcagagtctttcgtcatctcttctccggcgaagaacccccngtcgcccaccagatcacttgttaaactttgttgaggggtgatggcggtttctttcgcaaacctcaactccgaggcagggcttaaaaagcttgattantaccttctcactcgcagctacatcactggctaccaagcttccaaggntgatctggctgtntacacttcgtttcggctgctccctcgtccaagtanatcnacgtagcaagtggtttaccacatgatgcgctcgtgaggcgagcgga

SEQ ID NO: 4716 - DNA, 123 bp, Zea mays
  misc_feature: Incyte ID No: 700348919H1
  unsure 35, 90, 102, 108: a, t, c, g, or other
aagggaccgagggacgagggagacgttggggaggngagctagcgagccgtaacatccgagctgttccaatggcgacccctgccgttgctntcgtcgccagcnctttgntggggcggtggtagc

SEQ ID NO: 4717 - DNA, 174 bp, Zea mays
  misc_feature: Incyte ID No: 700348920H1
  unsure 44: a, t, c, g, or other
tccaaccattggtatttctgttgatcaccgccgcaagaacaaancccttgagggactgcaggcaatgtccagaggcttaagacatacaaggccaagctggttatcttcccaaggcgtgcacacaaggttaagggctggtgactctactccagaggagcttgccacggtaaccca

SEQ ID NO: 4718 - DNA, 114 bp, Zea mays
  misc_feature: Incyte ID No: 700348921H1
  unsure 29: a, t, c, g, or other
gtccgtaaacaactcccggccatggcgancgcagaccgggtcgccgccaccttcctctcctctttccccactcaccatccccgccccttttcctccgtttccctcgtgacaaac

SEQ ID NO: 4719 - DNA, 113 bp, Zea mays
  misc_feature: Incyte ID No: 700348922H1
  unsure 37, 47, 73, 93, 96, 98: a, t, c, g, or other
tcggcggcggagatgaggatgaagacgctggcgtgcngccggcggcngcctcaagacttcagcatcgatatgnaccaagagcccgacagggtngtnanaaataatggcctcga

SEQ ID NO: 4720 - DNA, 112 bp, Zea mays
  misc_feature: Incyte ID No: 700348923H1
  unsure 8, 58, 102, 105, 108-109: a, t, c, g, or other
cagggaantactcccaccctggagcctccgtagacctaaccatcttctccttacaccntagcaggtgtctcctctatcttaggggccatcaatttccacacnacntanncgg

SEQ ID NO: 4721 - DNA, 114 bp, Zea mays
  misc_feature: Incyte ID No: 700348924H1
  unsure 29, 33: a, t, c, g, or other
gacattataaatcaacgggagcaaagganaggnaagggagaaaatttcatatagcaattgtttcgcgtataggagggagaacaaaggtcgcgtctcgaaagttcttgccttgtt

SEQ ID NO: 4722 - DNA, 70 bp, Zea mays
  misc_feature: Incyte ID No: 700348925H1
  unsure 9, 14, 16, 19, 51, 69: a, t, c, g, or other
gggcactcnattananganacatacgcacatgcgtgccagcacacacacgnctggtttccacacaacana

SEQ ID NO: 4723 - DNA, 113 bp, Zea mays
  misc_feature: Incyte ID No: 700348926H1
  unsure 17, 39, 64, 96, 103: a, t, c, g, or other
atctcgcaccgctcgcnatggacctcctcgacgcgaggnaccgccacacgccggatttgagtcntcccaagatgccgcctccaacatggggctccngctcgcnggtgccgcct

SEQ ID NO: 4724 - DNA, 160 bp, Zea mays
  misc_feature: Incyte ID No: 700348927H1
  unsure 73: a, t, c, g, or other
gcgtgccctgggactctcgcttacagctagtgctatttcgatagcagaagttgcacgggtcgatgcgagctgncccacatttattctagtgcactcctcgttggctatgtccacaattgccctttgtggatctgaggctcaaaagcagaaatacttacca

SEQ ID NO: 4725 - DNA, 241 bp, Zea mays
  misc_feature: Incyte ID No: 700348928H1
  unsure 8, 44, 60, 64, 82, 87, 94, 105, 198, 214, 222, 224, 228: a, t, c, g, or other
ggcacgcnccactccccgccaccattaccaaccaaccaaccaanccgcgcacccccgaangagnagagcgggggtcggaggnccgangtcgganctgagcgcgcncccatcttccgtcggcgataagagctttgtctgtttcagcttcatgagttctgggatagcactggcatccaacatctcttattcaacagtgancagcagcattcatctntctctgcntntcgnggatatttggaat

SEQ ID NO: 4726 - DNA, 214 bp, Zea mays
  misc_feature: Incyte ID No: 700348929H1
  unsure 125: a, t, c, g, or other
ctccaggtaaggaaagtgttcgtcctcatggcgccgccgcagccgaagtcgggcctcttcgtgggcatcaacaagggccatgtcgtcaccaagcgcgagtgcctctgcgcccgtcccaccgcaangggaaagcaacgaagagggtgtccatggtcaggggctgatcagagaggttgctggctttgctcttatgagaagcgtatcaccgagtttg

SEQ ID NO: 4727 - DNA, 245 bp, Zea mays
  misc_feature: Incyte ID No: 700348931H1
gacttgatattctcttcttttgggtagcaaggatggtgatgatgggaatgcaacttggtggtgacgtgccatttcagaaggtttatttacatcctatgattcgggatgcacatggccgaaagatgtcaaaatcacttggtaacgttgttgaccctcttgaggtgataaatggcatgtcactggatggtctctgaaacgtttggaagaaggcaatctggatccaaatgaattaaacatgcaagagt

SEQ ID NO: 4728 - DNA, 195 bp, Zea mays
  misc_feature: Incyte ID No: 700348933H1
catcacataccgccgccgcatcgcatatgacaatgaagagcgccagaggtttgctgagaagatcattgtcctgctactgacagttgatgcccttgagggaccggactacatggtccgcaacgcaaggaggtccatgctggaggagctggaggggatgctggagatcgtggagcctcagccgccggggaagccgag

SEQ ID NO: 4729 - DNA, 100 bp, Zea mays
  misc_feature: Incyte ID No: 700348935H1
  unsure 2, 7, 16, 19-20, 34, 58, 73, 91: a, t, c, g, or other
cntttcnattttaggntgnngctgtgtgtcattnggttgcatgcacctagtatgggangcattgattacatgnctactaaatttggaaaanatgaggatt

SEQ ID NO: 4730 - DNA, 181 bp, Zea mays
  misc_feature: Incyte ID No: 700348943H1
  unsure 9-10, 175: a, t, c, g, or other
ctctctctnnctcgcagccatggcgaagaactacccgaccgtgagcgccgagtacagcgaggctgtggagaaggccaggcgcaagttccgagccctcatcgccgagaagagctgcgccccgcttcatgctccgccttcgcgtggcacttccgcggggacgttcgacgtgttcgtncgagga

SEQ ID NO: 4731 - DNA, 278 bp, Zea mays
  misc_feature: Incyte ID No: 700348944H1
  unsure 163, 232: a, t, c, g, or other
tgccaacctccaatagcgcttatattgacttgatcctcaaacctactgaagatgatttgaagatctggcctcatagttttgaataccgcctgagggttgcacttagtcctggtggtgatttgatgctaacttcacgtataagaaacactaatgcagacgggangccatctctttcactttgcatacccacacatattcaagatttctgatatcagtgagtgcgatagaaggntgggaactctggattacctagacacttaccagatagagtcgttccc

SEQ ID NO: 4732 - DNA, 191 bp, Zea mays
  misc_feature: Incyte ID No: 700348945H1
  unsure 145, 177: a, t, c, g, or other
ttcatgtcaattcatcttcggtttgagctggatgtgcttgcatatgctgggtgcttcgacatattcacacctgaagaacaggaaatcctgttgaggcatcggaacaaatattttccattgctgttgaggtattggggcaaatatnttccaggaaacacacctgactacaggaaaganggctcatggaaagt

SEQ ID NO: 4733 - DNA, 285 bp, Zea mays
  misc_feature: Incyte ID No: 700348948H1
  unsure 2, 8, 247: a, t, c, g, or other
cntttggngcgccgtcgctgccgctctactcgggtgcccaggtcttgttcgggcccttcgccggcgagccaggggacactttctttggtatgagaggatcaatgtccaattattatgatgattacgatgacattgatgagattgaggatgactatgatatggatgatcctgctgatgacatggtagacgagcagcgaggggttagggatctgatgcggaggataatgattatggacaaccaatgacnagatcccagatacttcatcagcagatgcgagaaatgga

SEQ ID NO: 4734 - DNA, 300 bp, Zea mays
  misc_feature: Incyte ID No: 700348949H1
  unsure 44, 54: a, t, c, g, or other
tgcagatgcaacctatgacttcaagtatggagttagagctgtancagggagacngaaggtcatcagccagagaaaccattggcagggtggctgcaggagctcttgcaaagaaaattctaaagctcaaatcaggagtggagatcttggcatttgtttctaaagtgcaccaagtcgtacttccagaagatgcagttgattatgagactgtaaccttggaactatagagagcaacatcgttagatgtcctgatccagaatatgcagagaagatgttgctgccatgatacggtacgagttagag

SEQ ID NO: 4735 - DNA, 315 bp, Zea mays
  misc_feature: Incyte ID No: 700348951H1
catgaacttactgttgttgaagcgaatgtagctgaacatgtatcttgtgacgaacaacaaaaaatcttaaacgaacaggattcactgtcaaatatgaacaaccatattggaatagttgagcatctagagcaaaataccgaatccaaggatgaaagagctgcatctgataagcaacctgaacctgtatctaggcagcataaacatttgaactttcctccgttcactacccagattcacttgaaaaagagtgcaacagagaatcctaatgttgtaaatcaggttgatataatgaaatcagttgcagtggttttagtt

SEQ ID NO: 4736 - DNA, 245 bp, Zea mays
  misc_feature: Incyte ID No: 700348956H1
  unsure 199: a, t, c, g, or other
agacggaaggagagcttgaaaataatgaccgaaacagccaacaaaaggaagcagattgatcaagttgtccactacttagaggaaagactgagagaactcgatgaagagaaagaagaactaaagaagtaccagcagctggacaaacagagaagatcacttgagtatactatattggaccatgagcttaatgacgcaaggnatgaattagcttcggttatcatccatcgcggctcgagctcgagccg

SEQ ID NO: 4737 - DNA, 312 bp, Zea mays
  misc_feature: Incyte ID No: 700348957H1
gttgcatatgggtacccgaacttgaagagtgtcagggagttgatctacaagaggggctacggaaaactgaacaagcagaggatccctctgtctaacaaccaagtcatcgaggagggcttgggcaagcacaacatcatctgtattgaggatcttgttcacgagatcatgactgttggcccacacttcaaggaggcgaacaacttcctttggccttttaagctgaaggccccgctgggaggtctgaagaagaagaggaaccactatgtggagggtggtgatgccggtaaccgtgagaattacatcaacgagctc

SEQ ID NO: 4738 - DNA, 312 bp, Zea mays
  misc_feature: Incyte ID No: 700348958H1
  unsure 94-95: a, t, c, g, or other
aacaactcatacgggaaaggacgaggagttgttggcattctggaggccaactttatcaaacctacccatgacaagcaggattttgagaagtcanncctttatcaaagacttgagttccgcttgaaagaaatgacttacgaatactgggaccttcattgccatcgtgttggatatgacaacaaaaaattacctaaagcaacccgtgctattaatcgtgccaatcatatgaacggtggcagttccccaacaagtgctccacctcggttgcttgcagttgatattccaacaagcagctctagtatacctagatta

SEQ ID NO: 4739 - DNA, 313 bp, Zea mays
  misc_feature: Incyte ID No: 700348960H1
  unsure 310: a, t, c, g, or other
aatgctgttgatgtgcttgaagggaggcaatatcgcttacaacacccctgggttggaattgtcaatcgctcacaagctgatatcaacaagaatgtcgatatgctctcagcaagacgcaaagaaaaagagtactttgagagtagtcctgaatatggtcacttggcacataaaatgggtgcagagtatcttgccaagcttctgtcacagcatttagaggctgtgatcagggcaaaaattccaagtattatagctatgattaacaaaacaattgatgaaatagaagcccagttggatcgacttggtaggccantgg

SEQ ID NO: 4740 - DNA, 314 bp, Zea mays
  misc_feature: Incyte ID No: 700348961H1
acactgtggaccaggtgctgagtgaggtgagccgggtgctggttcctggaggccgattcatctccatgacttctgcgggtccccacttcaggatcagacactatgctcaaccctgttacgactggtcactgaggcatacaacctatagcagcggttttcacttccacttttacgtcatgcataagggcagagagctcactgtgtcccagctggccctaggggcccagatcctctcaccccccagccctcctgccccaccctgcttcctccaagactcagataatgaggacttcctcagtgccattcagctgtga

SEQ ID NO: 4741 - DNA, 319 bp, Zea mays
  misc_feature: Incyte ID No: 700348964H1
atcatatcttgttcaaaggactgctctatattttaatgtcttattgaaacgttttttaaaatacctatctcgttcaaaagggtgctctatattttaatgacttattgaaacgtttttttaaacaatatcttactgtcatgtaatgttttacagctttgccctacctttagctcatcaatcatcaagaacatcctggatgtctttttaccagatgaattttgtccagatcccattcaaggttctttacttcaagcactagagttggaggaccacctggaggttaacaagggcatacggtcgatcccgtgcagcgcatcgc

SEQ ID NO: 4742 - DNA, 76 bp, Zea mays
  misc_feature: Incyte ID No: 700348966H1
  unsure 67-68, 70, 72: a, t, c, g, or other
ccgccacctccgtggctgtggctaccttcccggctgcccgggctccaatggtttccacacaacatannancngccc

SEQ ID NO: 4743 - DNA, 307 bp, Zea mays
  misc_feature: Incyte ID No: 700348967H1
  unsure 133: a, t, c, g, or other
cacgctgtggctcacaacacaaggggtcacaccatgcgcccattgatgcgtcctcgttgggctaggcagcacaacatcgacagaagcagaatgtaaaggtatacttctggcaacggcctatacagccattganggctagtttgaaacaccgttcaagggattttcatttttcaaagggaaattagctcattttcccttgtaaaaatgaaatttttttaggaaaatggtgttcccaaactagccctaagtattgctgttgcccaagttaaacaaaaaaacgtgtctattatgggctctgtttgtttac

SEQ ID NO: 4744 - DNA, 304 bp, Zea mays
  misc_feature: Incyte ID No: 700348968H1
  unsure 47: a, t, c, g, or other
ggaatggctactatgttatatgccactgcccaggagtgctgctgctncaatatgatttcgccatgacaccatctctctcaggggggttgatggcccttagctcaatctttgttgtcagcaattctttgcttctgcagctgcatgggtcgtttcagaacacagaaaaacggcagggtgatctgagctcaagattaaactgaattgttgggtttagtttgacccagccgaaggacagtggtattgaattatagagggttctgatactggttttccagctccggctaattgaactgagtcagaacta

SEQ ID NO: 4745 - DNA, 69 bp, Zea mays
  misc_feature: Incyte ID No: 700348969H1
  unsure 12, 45-47, 50, 54, 65, 68: a, t, c, g, or other
gttgccctcggncccagcaacatccaggggccacactaaaccccnnnccntttnccacacaacanagna

SEQ ID NO: 4746 - DNA, 305 bp, Zea mays
  misc_feature: Incyte ID No: 700348970H1
  unsure 47: a, t, c, g, or other
ctggaggtgtgaaaaccattggaaactatgcctcggtactgaaagcncaaaagattgcaaaggggaaaggatattctgatgtcctttatttggatgctgttcatgacaaatatcttgaagaagtctcttcctgcaatatttttgttgtgaaagacaatgttatttctacgcctgccattaaaggaacaatacttcctggtataacgaggaaaagtatcattgaagttgctcagagcaaaggtttcaaggttgaggagcgtctggtgtgtgtagatgagttgattaacgctgatgaagttttctgc

SEQ ID NO: 4747 - DNA, 298 bp, Zea mays
  misc_feature: Incyte ID No: 700348972H1
  unsure 26, 28, 53: a, t, c, g, or other
ccctaggcccctagctttcccgcgancnggacggcagccgccgtatcctccanccctccaataccgagcgggtccaggcaggtagcatcctcgcgccctgtcgtgtcgcctccgcctctgagttcagctcgccggcagccgccgcccgcaatggaggccctccggaaagcggaggcggagttcacggtgtacgtgcacccctccaacgccaagcgcgtccggcacgccgtatcccgccagcttagcgcgcttctcttcacgtatgtggaccgttttgatggcgtgttgctgatgcatg

SEQ ID NO: 4748 - DNA, 305 bp, Zea mays
  misc_feature: Incyte ID No: 700348973H1
  unsure 39, 50-51, 82: a, t, c, g, or other
ctgattattaaagccccgctttttcaaaagccgcaaggnctatacccctnngttgtaaattggcggaaaggaaattcgcctnctcttctccaattgcagctgcagttgcgtgctcgagaggggtgaagaacctagaagccctgccagcgcgcggcgccggcgccttgtttactctgcgacggcacgctgattgcattggtactgttcttctcctgatcaccacacatgacaagggtcatccatgactccggagatgacatgcagaaggaggcacttgatttggtctcatctgacgttaatttccc

SEQ ID NO: 4749 - DNA, 307 bp, Zea mays
  misc_feature: Incyte ID No: 700348975H1
  unsure 128, 144-145: a, t, c, g, or other
gcttcatcggctcgcacctcgtggacaggctcatggagaacgagaagcacgaggtcattgttgctgataactttttcaccggttcaaaagataacctgaagaagtggatcggacacccaagatttganctcatccgccatgatnnccactgagccacttcttgtggaggttgaccagatctatcaccttgcttgccctgcttcaccaatcttctacaagcacaatcctgttaagaccatcaagacaaatgttattggtaccctgaacatgctgggacttgcaaagagagttggagctaggattttgt

SEQ ID NO: 4750 - DNA, 284 bp, Zea mays
  misc_feature: Incyte ID No: 700348978H1
  unsure 75: a, t, c, g, or other
agccaggaacccttgattgcctcgtgcttatgatcatttggtattgctactcagtctttcttcctagcataagtnagctcgtgcaagagctgtctcgcgttgcgcactgggatctatctgtagtattagtaccataacgtaacggctactgtattttgcaatgtttttttttctctctcgcttttgttaggtgttcatggaatttcattctatgtatcaccattgcagttgtaatgtgtttttgctggaaataaggaataaggtagatggccggttgcctcgcc

SEQ ID NO: 4751 - DNA, 309 bp, Zea mays
  misc_feature: Incyte ID No: 700348979H1
gacagtgtggcacgtttcttggaatcacgtggaatgttggaggaagccctcgagatagcaactgacactaattacagatttgacctggctgtgcaacttggtcgacttgaaattgcgaaggcgattgctaccgaggcgcaaagtgagtccaagtggaagatattaggggagttagctatgtcaagtggaaagcttgagatggcagaggagtgtcttctacatgctatggacctcagtggtttgttgcttttgtattcttcccttggggatgctgaaggcattaacaaattggcatctgtagccaaagaa

SEQ ID NO: 4752 - DNA, 314 bp, Zea mays
  misc_feature: Incyte ID No: 700348980H1
  unsure 57, 154-155: a, t, c, g, or other
ctgctgaaaaaggttaactttatctctggggctaagcttcaattccggcatctgccncattcttcagtcttaatgtcattgccgccgagtacaacagtgactcatcggtgcatgcacaccaaggatgtcatcactaccagcaccatcaacgacnncaatagtgaagagttagtcttctactctacacgggagtaccacaccaaccaaaatggctcattgttgccaccaaacagaatgtatagcctattatgtctggcacttagggactcgatagctttaagggcaagttatgcactcaagtgactatcataggg

SEQ ID NO: 4753 - DNA, 300 bp, Zea mays
  misc_feature: Incyte ID No: 700348982H1
  unsure 64, 189: a, t, c, g, or other
gcagatcagcaacttcgccagcatctggttcatctccctcttcatctcgatcttcgccacgggnatcctggagatgaggtggagcggggtgggcatcgacgagtggtggaggaacgagcagttctgggtgatcgggggcatctccgcgcacctcttcgccgtgttccagggcctgctcaaggtgctggncggcatcgacaccaacttcaccgtcacctccaaggcctcggacgaggacggcgacttcgcggactgtacatgttcaagtggacgacgctccttatcccgcccaccaccatc

SEQ ID NO: 4754 - DNA, 295 bp, Zea mays
  misc_feature: Incyte ID No: 700348983H1
  unsure 40, 227: a, t, c, g, or other
gtgcttggagtgatccttcacaaggtggtggatttggtgnctcagtcaatggaggttctgaagggcaatcaaactatggcactggctatggcagtgtgcagcccagggttgctcagtaaagaaggcattttgagtgtctgaaatgaaccagcacatctgggcagtctatgtattgatttgtcatccagttctgatttgttctcagcatctgaagattgcccatttgnctggttaaatcagtattctccgggttggaatgctgatccttagtggctactactagaacttgtagtcc

SEQ ID NO: 4755 - DNA, 298 bp, Zea mays
  misc_feature: Incyte ID No: 700348986H1
tgcagagcaggtttcagttgataacaaacctgtgtaaattcttggtcactattgcagtatcatcactagcatgaagttttcgccagatggacggttcattgctactgctgatagggacttcaaaatacgagtcacattattcccaaagaatcctctaaaaggggcccatgaaatacagagcttttgccttgggcatacagactttgtatcatgcatcaccttcactagcatatctgaaaaccagagtttccttatatcaggaggaggtgattcaactgttcgcctgtgggactatgta

SEQ ID NO: 4756 - DNA, 277 bp, Zea mays
  misc_feature: Incyte ID No: 700348987H1
  unsure 2, 72, 88: a, t, c, g, or other
gnctcgccaattcaactccgcatctgaatcggcactcggcagcgcgccagctccatagtgtaggaggagganatggcgctcacaagantcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaatccattcagaa

SEQ ID NO: 4757 - DNA, 297 bp, Zea mays
  misc_feature: Incyte ID No: 700348988H1
  unsure 102, 230, 243-244: a, t, c, g, or other
ccataccggcggctctctgtttctcgaatccccgatcctatctcatcgaatagaaactgttccgctcccactccgatcggattcggtgggacggtggcatcnatgcgcccgcggcaccgtcgctcaaactgtataaacctgcgctcgaacacttcgagctcacccgcaacctcctccgggaagcgcgatcgccatctcgaaggagctgagatccaagattccaagctctnctgtcacaggttnntggaagttgaagcaaaaatgttctacgggggatatgcttaccatggcaatcgt

SEQ ID NO: 4758 - DNA, 300 bp, Zea mays
  misc_feature: Incyte ID No: 700348990H1
  unsure 18, 20-21: a, t, c, g, or other
ggtcggaacgcagcgcangnncgggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggag

SEQ ID NO: 4759 - DNA, 298 bp, Zea mays
  misc_feature: Incyte ID No: 700348992H1
  unsure 190-191, 197-198, 246: a, t, c, g, or other
aacgatcctgacctatccctgaagcagaacaaagtccctgattatgccgagcggctggtgaagaagcagatgcgcgccgcttggctgttcagggaagcagccctgaagcacgggggcgtccgtcgcgcgggggatgctagcgacgctgcgtttggccaggaggccgacgactccgagtgggagacagcanncgaaannacggcgagaacggtgccgccacggggggagaagcagacggtgagactngatggaagaatggtggccgccaggaagatttctgtgagaaaagctgagcaac

SEQ ID NO: 4760 - DNA, 300 bp, Zea mays
  misc_feature: Incyte ID No: 700348993H1
  unsure 6, 38, 54, 63, 69, 112: a, t, c, g, or other
aaaganggacgaatggcgagctctcagtgctgcgatanccccgccggccctgancccggcctnccgganagggcaaggtccgtcgacagcttcggcgggctcaaggcctacntcgccggccccgaggactccaaggccgccgtcgtcctcgtcgccgacgtcttcggattcgaagcgccgattatgaggaagatagccgacaaggttgcttcgtcagggtactttgttgtggtaccagatctgtttcatggggatcctatgcacctgagaatgttgagaagcccttcctgtgtggataaa

SEQ ID NO: 4761 - DNA, 302 bp, Zea mays
  misc_feature: Incyte ID No: 700348994H1
  unsure 239: a, t, c, g, or other
aaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcanctgagcttttcatccaccttgtcccagacaaggccacgaacacgctctccatcatcgacagcg

SEQ ID NO: 4762 - DNA, 300 bp, Zea mays
  misc_feature: Incyte ID No: 700348995H1
  unsure 3, 42, 63-64, 110: a, t, c, g, or other
ggncgcggcaggggccaggcagtccatccccatgtgtttgtnactttgtgctcgtcctcatanncccaccccccagctcccgtctcctcgtgctctccactgctgcatgncgcctcttgtcctgtccccctccccaccttgttcctcccatcccgcgccgtctctgcacgaagcagagcgccggtccaccgacaaggacagctacaatacgacgcgcaggcagagccatcgctcatctggggtgccctcggttactcttcccttcggccgtgccctgccttgtcacagtgtgttaattcc

SEQ ID NO: 4763 - DNA, 305 bp, Zea mays
  misc_feature: Incyte ID No: 700349001H1
  unsure 289, 291, 304: a, t, c, g, or other
agtgcacattgctaaacgctcccgccgtctcgcgagccgccgccgggtccttacgcaagttccgcgacgtgcatcgcctggagaggctcccgtctcgccgccctggggatcccatctcatctgtgcagccgcgcgtggcccaagggagccagaagctaagagttagagaggcgcgtgatgtcttcagaggaggcgagggcaagcttttcggagttggtggttggttcgccaacccggaccagagggcgaaattattcttcaggtgatatgtcgtctgaggagggtgcanangtcattgtttcana

SEQ ID NO: 4764 - DNA, 293 bp, Zea mays
  misc_feature: Incyte ID No: 700349002H1
  unsure 18-19, 66, 243: a, t, c, g, or other
gcatttgtgctacgaggnncttttgcaatggcggcttcggggttcggcggcggcgaggcgttccgnctctcggccgcaccaggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagtagtgcaagcatgcnggaaattccagaggtcaaaccaggattcgttgtcctatggagaactagga

SEQ ID NO: 4765 - DNA, 175 bp, Zea mays
  misc_feature: Incyte ID No: 700349003H1
  unsure 24, 29, 51, 54-55, 59, 67, 140, 159-160, 164: a, t, c, g, or other
ctgaaaagaaaaatagcaaaatgnctgcncgctcagaaggctttggctaanggnntcantacttttncattccactcttgtcaactttagccaaagccttctgagctgcagttgacaagagtggaatgaaaagtattganactttttttggggtaaaanntaanaaaaaaattgg

SEQ ID NO: 4766 - DNA, 294 bp, Zea mays
  misc_feature: Incyte ID No: 700349005H1
  unsure 98: a, t, c, g, or other
caccaaacaagtgccagcgccctctcgcagtcgccgcaatggagagcaccttcatcatgatcaagcctgatggcgtccagaggggcctcattggtganatcatcagccgttttgagaagaagggcttctacctcaaggccttgaagcttgtcaacgtggagaggtcgtttgccgagaagcactacgccgatctcgcctccaagcccttcttccagggcctcgtggactacatcatctctggccctgtggtggccatggtctgggagggcaagagcgtcgtcacaatggccgcaa

SEQ ID NO: 4767 - DNA, 284 bp, Zea mays
  misc_feature: Incyte ID No: 700349006H1
  unsure 71, 98, 247: a, t, c, g, or other
gatgaactctttcagaatctctgcatcatggcacaaggcattcgtggactatgaaaaactatcaacctgtntgatggacaaagtttacaaacttgaancggagaagaaactattggaggaacagtcccaagaccaacaaaatgagatttataagctgaaggccaatctggaaagctgtgagaaggccatagatgactgtactcttcaacatgaattggagaaggatgccattcttttagagctcctnaacctccagaaggaagtatctatcttgtcatcatctt

SEQ ID NO: 4768 - DNA, 296 bp, Zea mays
  misc_feature: Incyte ID No: 700349007H1
  unsure 45: a, t, c, g, or other
ataatgctgcaaggcacttgctgcacccttgacgagaagaacccnccgtccgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtg

SEQ ID NO: 4769 - DNA, 292 bp, Zea mays
  misc_feature: Incyte ID No: 700349009H1
gcggcgtccatgacggtaccgagatcgtgctctggaagtggtgcgagggcgacaaccagcgctggaagatcctcccttggtgaacgaacgaaagaaactactagctggtaccctaataataattctgctggctgcggcgatcccaaaataaaagaggccgggtgcgatgcatctcggacttctcgagtggtgtttgcgtcagacagccagccactgtggggctagtgttccaacatttgtcagcctgcttgcgcgaggaaggggggtcactgactcaagagaagggcctggt

SEQ ID NO: 4770 - DNA, 292 bp, Zea mays
  misc_feature: Incyte ID No: 700349010H1
cctgcacgttcggtcgaggtctatcgtgaacccactatccgagattgatgtggatcattgggttgacaggtcatacagtatagagccggtggcagaggaattcctgtttgctgtgggtaaagcttatcttctgctttcgtgttttttcttgcttctttcgattatggtgtaggaatgtggtcataatgtattagctgattatcctttccctgctaattggactttattacgcttcattaagtttggctgattactgtttaacggggaaaagttgcacctgtgtacgattatt

SEQ ID NO: 4771 - DNA, 293 bp, Zea mays
  misc_feature: Incyte ID No: 700349011H1
  unsure 55, 115, 118-119, 126-127, 191, 198, 275: a, t, c, g, or other
cctctgcaaggcctcaatcagaatcatctaggacatcttgtgatgggagttgcancaacactagtcgcagaatcaatttgttgaacagaagtccttttgatcctcagataccccngannaagcacnnttgcatccaggataacgaattttgctaccaaggtcacaaataaagttcgttctcgggtcagcanagacgantatgggctagaacgggaaggtggcagtggtgagagtcattgttcggatcgtggtgcaaaggaagaaccaacatctancggaacaaatacacctag

SEQ ID NO: 4772 - DNA, 235 bp, Zea mays
  misc_feature: Incyte ID No: 700349012H1
gtcacatcatattgagcatccattgagagaatcatttatttaatattgtgaaccttacttgaatgtcatttagatataaatgctaagatcaattaaggtctagtttaattctcatagaagcatatatggactaatagtaatatggtcaagtcaattcacgattcctcatatcttattcactttggcttgaccaatcctcttaatcacttcaacctctattctgatccctccataa

SEQ ID NO: 4773 - DNA, 295 bp, Zea mays
  misc_feature: Incyte ID No: 700349013H1
  unsure 2, 11, 15, 21-23, 26, 29, 31, 68-69, 231-234, 240, 242-243, 254, 256-260,: a, t, c, g, or other
cncatacatanactntaacannncanatngntccacaacaatcacatatatctaatacatctatagannggtcggctgatacctctcaagcaagtgtagcttcagatagcacagatggcaggccagtgaagtacaagctggtagccgatttgctatggcggttgagcaaaaaaatttatacagatgaagaagcacttctcacagagatagaagaaccaacaagctaccgtnnnncctcantnntatcggaagancnnnnnagctgntntcctnnacnaagtcattaccagcagcg

SEQ ID NO: 4774 - DNA, 291 bp, Zea mays
  misc_feature: Incyte ID No: 700349014H1
agttttctcatgagaatcagatggataaaatacttgatgatattcttgagaggtgtttctcaactgtattagccaacagctgctcaaagacatctcaatcttgtgctggcacttcagatgttaatttctcagatgtttcgtctagaaacaagctttctaagattaatatcttgtctagcttggcttggattggcaaaggattacttatgagaggagacgagaaagtgaaggacatttcaatgtttcttcttaagatcctatgctcagatgagattttgtctacagttccat

SEQ ID NO: 4775 - DNA, 293 bp, Zea mays
  misc_feature: Incyte ID No: 700349016H1
  unsure 2, 34, 85-109, 136: a, t, c, g, or other
ancatcttcatgacgtcggccatggagggttgancgtcgtcacccatggtgatgaacctggacgtagcggtggacggggaggtgnnnnnnnnnnnnnnnnnnnnnnnnncggtggctgaagggctgggggtggtgntaaaggatcgccgacttcctgataccaggttgtcaagggcgtcgggcccgagggtaggaggaccgcggctccgaagatcgtaaccgccgtccgtgttgccgaccgggttatgcccccaggaacggcgttcttcgtcaacgggttatgccccctgttg

SEQ ID NO: 4776 - DNA, 293 bp, Zea mays
  misc_feature: Incyte ID No: 700349017H1
  unsure 6, 13, 34, 90, 93, 102, 134, 153, 158, 230-233, 245, 247, 250, 261, 266,: a, t, c, g, or other
cgccgnccaccanctacgccccgcctgaagtgcnctcgggggtcgccgccttgttcctcaccatcccctatgccttcttcctaccggagntgntgtttgggntctgggtgtggactctggtggctgccacacangtggcataccccctgctgnacggntgggtgctgtatgtctcgctcacgtcattcctcgtctccctgatgctcctgctgtcctacatattcgggtcnnnnaaacgatttgantnctngagagtactgnacagnctgtaccagggcaccacatgnattnnt

SEQ ID NO: 4777 - DNA, 293 bp, Zea mays
  misc_feature: Incyte ID No: 700349018H1
  unsure 3-4, 36, 40, 57, 59, 147, 159, 197, 209, 211, 228-229, 237: a, t, c, g, or other
cannatggctcccgcaaagaagggtggcgagaaganaaanggccgttctgccatcancnaatggtaacccgagaatacaccatcaacattcacaagcgcatccatggagtgggcttcaagaagcgtgcacctcgggcactcaaaganattcggaaattngccatgaaggagatgggaactccagatgtgcgcattgncaccaggctcancnaagctgtctgggccaanngaataagnaatgtgccataccgaatccgtgtgcggctgtccagaaaacgtaatgaggatgaaga

SEQ ID NO: 4778 - DNA, 290 bp, Zea mays
  misc_feature: Incyte ID No: 700349019H1
tggtcgtctctgctgtttatgaaggaggagctgcagagcggcatggtggcgttgtgaaaggggatgagatcatggccatcaacggcaagatcgtgacggactacaccctggctgaggctgaggctgccctgcagaaggcctggaatcagggcggggactggatagaccttgtggttgccgtctgtccccccaaggaatacgatgatgaactaaccttcttttaaagtccagagacagaagccagccagacccatcctggaagctggcaactcggcacccagcccctgaag

SEQ ID NO: 4779 - DNA, 290 bp, Zea mays
  misc_feature: Incyte ID No: 700349022H1
  unsure 90: a, t, c, g, or other
atgttcaaactttttgcatgtgcaatttgtcaaattgacttggaatctggccaaggcatatccatacacgagggtttgtcaaggccaggnaagctgcgtccctgggatggccctttcctttgtcacagctgccaggaaaagaaagaggcgatggaggggaagcgccattcacgagattcctcgtccagaaatagcgggtcaagtgaatcgtgactgaagccgagaatcatcttgaggcaaacgcctagcggtgtgacgagctaattatcgttgctgctgttatcttgcag

SEQ ID NO: 4780 - DNA, 287 bp, Zea mays
  misc_feature: Incyte ID No: 700349024H1
  unsure 36: a, t, c, g, or other
ggcgtgccgacggtatccatggcggcggtggtgcgnggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcataggtgggtagaatatgcagagaaaggtcgttacaatgcatcccaagtgcctgc

SEQ ID NO: 4781 - DNA, 288 bp, Zea mays
  misc_feature: Incyte ID No: 700349025H1
  unsure 90: a, t, c, g, or other
aaacgatacaggaatacgatacgccgctcgcctgaatcgagaccaccaccgctcccgctctgcctcacctcgccgactagagtttttgcngccgcggatctcgccgtccccgccatggatacgtcgggctcctccgcagccgccggcgacgccccgaccaccggggagcaccggatggggaccaccattgtcggggtctgctacgagggtggcgtcgtcctcggcgctgattccagaaccagcactggaatgtatgtagccaaccgtgcttcagacaagattacccaa

SEQ ID NO: 4782 - DNA, 288 bp, Zea mays
  misc_feature: Incyte ID No: 700349027H1
  unsure 81-109, 115-116, 121, 196-197, 235: a, t, c, g, or other
tcacttgctctccctccaacaagctaattaaggccggtcatccctcttctagctcgtttcattatccatggcggaggagannnnnnnnnnnnnnnnnnnnnnnnnnnnnaagaannaccgnagcaggaggagcagctcgccggcggcggtacggcgagtccgccgagtacacggaggccacggtgacggaggtcgnntccacgggcgagaacgagtacgacgagtacaagaaggncgagaagcagcacaagcacaagcagcacctcggcgaggccggcgccatcgccg

SEQ ID NO: 4783 - DNA, 280 bp, Zea mays
  misc_feature: Incyte ID No: 700349028H1
  unsure 74, 115, 247: a, t, c, g, or other
tgtcgcttcctgctcttgccctgtaaagatgcatccaggtggcaagggacactgccagggtcattctcactgtnggccacctcctgcccatggtccaggacactgtcctgggggnaatcaccctccaggacctggtggcccatcccatagccatagtccaggacactgtcctgggggaaatcaccctccaggactggtggcccatcccatggccatggtccaggacatgtctgggggacaacatcancctccaggactggtggcccacccatggcatggt

SEQ ID NO: 4784 - DNA, 288 bp, Zea mays
  misc_feature: Incyte ID No: 700349031H1
agcaagaagaaaattgagcaaacaaagaatgtacgtgatgagagaaggaaggtaccgttgaagagttctcatcatgattctgagtctgatgcagatattgactataggaagaagaaaatagaacatacagagggtattcgtgatgagagaaagaagataccagcgagaagctctcgccatgattctgactctggtgcagataataatgggaaaaacaagagaccagtgcaaagctcttgtcatgatttggaggatgagaagcctagattgagaaattatattatggct

SEQ ID NO: 4785 - DNA, 291 bp, Zea mays
  misc_feature: Incyte ID No: 700349032H1
  unsure 42: a, t, c, g, or other
gggtagagatcgaagatctaggtcacgttcaagaagcaagcnagttagtggattcgacgccccacccccgcaagcaatgggttcaacatttccagttattccaaccccaagtcagttaccaggctcttcgcttcccaacattggtggcatgtttccaaacatgctccctttcggtgttgctgggcagttcaatccccttgtcatccagccacaagcaatgactcaacaggctactcgtcatgctcggcgtgtttatgtcggtggccttcctccatctgctaacgaacagac

SEQ ID NO: 4786 - DNA, 292 bp, Zea mays
  misc_feature: Incyte ID No: 700349034H1
cagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaa

SEQ ID NO: 4787 - DNA, 290 bp, Zea mays
  misc_feature: Incyte ID No: 700349035H1
  unsure 53, 58: a, t, c, g, or other
gctgtttgctgtttttcgtttctcccgttcacctggcatccacgctcgattcngccgntttccgcatccacggagccaggcgaccgccgccgcttccctactcacccttggccggcgacgacgagcgccaccacggcaggatgacgacgctgaggaacctcaagatcaagacgtcgacgtgcaagaggatcgtgaaggagctgcgctcgtacgagaaggaggtggagaaggaggcggccaagaccgccgacatgaaggagaagggcgctgatccctacgacctcaaacag

SEQ ID NO: 4788 - DNA, 58 bp, Zea mays
  misc_feature: Incyte ID No: 700349036H1
  unsure 8, 19, 23, 41: a, t, c, g, or other
aagcggcntcatgggcgcnggcnacgactactacgagcgcngcaacctggacatcttc

SEQ ID NO: 4789 - DNA, 288 bp, Zea mays
  misc_feature: Incyte ID No: 700349038H1
  unsure 8, 12, 14, 124, 199, 201, 246: a, t, c, g, or other
tccccgcnccgncncgctcccggatcccaccgaaacaaccatggccggcggtcccgcggcggtgtcgttcctgaccaacatcgcgaaggtggctgcggggctcggagccgcggcctcgctcgcntccgcgtcgctctacaccgtcgacggcggcgagcgcgccgtcatcttcgaccgtttccgcggggtgctcccgganancgtcggcgagggcacccatttcctcgtgccctggctgcagaagcncttcatcttcgacatccgcacgctcccgcacaacttctcctc

SEQ ID NO: 4790 - DNA, 283 bp, Zea mays
  misc_feature: Incyte ID No: 700349039H1
  unsure 31, 110, 153-154, 156-157, 206: a, t, c, g, or other
tttccatctggagctactgccttgccctcanaggatctaagacatggcacccaagaaggccaagagaagggcagcagcagaagggagctccaatgttttctccatgtttncccagactcagatccaggagttcaaggaggctttcactgtaanngnncagaacagggatggcattattgacaaggaggatcttcgggacacctttncggccatgggcctctcaatgtgaagaatgaggaactcgacgccatgatgaaggaagccagtgggcctatcaacttca

SEQ ID NO: 4791 - DNA, 286 bp, Zea mays
  misc_feature: Incyte ID No: 700349043H1
  unsure 2-3, 6, 8, 33, 39, 42, 46, 49, 55-56, 60, 63, 105, 108, 117, 138: a, t, c, g, or other
cnngantnccatatcagatcccatactgccccnagcgangcntacnacncaacannatanctnggagaggagggagagaacgaagaaggcgaggccaaaaatccnctncccctcccncaatcctagcccaataatctntcaatcaggggattcttaggtctgatcaagtcggaggattcggcagggcgcagcatgaacgagaaggcgtccgtctccaaggagctcaacgccaagcacaagaagatattggaaggtcttctacggcatcctgagaatagagaatgcg

SEQ ID NO: 4792 - DNA, 281 bp, Zea mays
  misc_feature: Incyte ID No: 700349044H1
taccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgt

SEQ ID NO: 4793 - DNA, 284 bp, Zea mays
  misc_feature: Incyte ID No: 700349045H1
  unsure 40: a, t, c, g, or other
gtcgcgtgcggaactagagctccttcagagaagtgccgtnccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatct

SEQ ID NO: 4794 - DNA, 283 bp, Zea mays
  misc_feature: Incyte ID No: 700349046H1
  unsure 59, 136-158: a, t, c, g, or other
ctcggaggcgacagtcgaactcgaatccctcatccagcctgtcgctggcgtcgccggtngccgccgctcgattgcctccgcctgaatatcccttgccccataaggcctgaccttgaaagcctcgccacttgatccnnnnnnnnnnnnnnnnnnnnnnnatgccgaagcggacgacacacacctactcgagcgaggacgcactgccggagggccccgagtccgaccttttcgtatactactgcaagcactgcgcctcacatgtcctcatcaccgatacccaatt

SEQ ID NO: 4795 - DNA, 282 bp, Zea mays
  misc_feature: Incyte ID No: 700349047H1
gcaaataaagggtgggtgtgtctccacctatacatatagtataatagtgaggtacccgtagagaccatataaatcagagggttttatatttcaccatttgataagaaaatactcgtattaggaaggttcaaaaaggagaggatattgtatcttctatatatcttacttggtgctttatcattttcaaatgccaatcagtgaacaccaaatttcaggtttgttaaatgcctgttaccagtcaggaatgagatattatcttcagataataaataaaatactggg

SEQ ID NO: 4796 - DNA, 243 bp, Zea mays
  misc_feature: Incyte ID No: 700349050H1
  unsure 2, 12, 17, 20, 25-26, 59, 97, 109, 198, 203, 207, 214, 218, 220-221,: a, t, c, g, or other
gngaacacatgntatgngcntgtanntgtgtaatctgatcatgcactcaatggttgganaaggcactccagtgcgaggaaaataaccagaagccaanatatcgattctnatatctcggtttatgttaccaactgaatatggtgtaatgcataactttttccagtaaataaactggttattttttgttcatttcaaaanaaaanaaanaaaaaancaanannaannaggacaaagnnntgaaaa

SEQ ID NO: 4797 - DNA, 293 bp, Zea mays
  misc_feature: Incyte ID No: 700349052H1
  unsure 43, 45, 57, 70, 72-73, 78, 83-84, 87, 90, 113, 128, 132, 134-135, 146, 157,: a, t, c, g, or other
cttttggtgatggcgggaagaatcataagctactatgaatccncngctagcattgtngtgctcaccttantnngctantagtnnctncantactagaacagagtagtactaanatgacaatgaatacnatantnntggtgtaaatnaaaagtatgtnctactctgtnctagtattgagcaactactagttaattaaggtgagcacaacaatgctagctgaggattcatagtagctnncnggctcttttggtgatggcgggaagatcgactttnacgtagcaacggataaanac

SEQ ID NO: 4798 - DNA, 288 bp, Zea mays
  misc_feature: Incyte ID No: 700349053H1
  unsure 47, 58, 62, 71-72, 76, 85, 92, 106, 110, 124, 139, 147, 218, 261: a, t, c, g, or other
cgcaacacctgctcctcgcccccttctctcagaggcgacgcctcggngcgctcctaanctgntcccgtctnnggtnccccccgcngccgtcnggtaggcagccggncgtnacagaagcccgatncggaccccgcgaganatccttgntatacctgatggccatgattgatgagcctctttatccaattgctgtactgattgacgagctcaagaatgangacatccagttgcgtctaaactccattagaagactttcaacanttgcacgggctcttggagaagaaagaa

SEQ ID NO: 4799 - DNA, 292 bp, Zea mays
  misc_feature: Incyte ID No: 700349054H1
cgtcccctagtccctacgaccctactccctaccgcacgccaccgcccaccagcgccgccgaggggcaaggccgaaccctcctccgtttcgccgaggcggagcacgcccttccaggccagcttccaccggagcaagagctaagtcgcctcgaattcttcccagctagtagcgtgtgccgtaccccgtcgctcaaccgggatggcgtcgagtggggatccgcccggatctgctgatgagaagaaaactccaatatccgaaggtcttccgacgaacgtcaagggttcctccagca

SEQ ID NO: 4800 - DNA, 292 bp, Zea mays
  misc_feature: Incyte ID No: 700349055H1
  unsure 52: a, t, c, g, or other
ggcggcggcgcaggcgcaggcgagcggtcgtccgtccaggcgcaggcgagcngccgtctgtccagcgcaggctagcggccatccgtccaggcgaactgcgagcaggcgttcgtccaggcttccatccagacgagcggcagaacttttctacgcacaacacattccaagaaccgaaaatggagagtgaaggagctggtgagcactttgtggaacaagctgatggtagtggccatgttgtgtggacttctacaatgtccgcttacatgctcagtaacctagcaagccttgtggc

SEQ ID NO: 4801 - DNA, 290 bp, Zea mays
  misc_feature: Incyte ID No: 700349056H1
aaatccaccaccgccataccagcgtgtccgcgattccgtcgagtagactgggcgagagagtagtctcggacgagaagaggcgaatatgagttccggcggcggcaggggcaagcccaaggggtccaaggctgtgtcgcggtcgaccaaggccgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggca

SEQ ID NO: 4802 - DNA, 289 bp, Zea mays
  misc_feature: Incyte ID No: 700349057H1
  unsure 48-50, 56-57, 60, 70, 77, 103, 190, 237, 266, 268, 270: a, t, c, g, or other
gagcgatgtgcctacattggttggcaatgacgatgcggagagtgaggnnnctgtgnngancactacagtncgctgancaggtggatgagtatgctggcatttnatccccaatatcaacatactcatccacctgctcagccactgtagtgctcttcacaggtggaaacagtatgttgatattggggatganatgccagcagccacttaccaatccatggagatcgagaaggacgctgnacgtacgactggctctggtggttctccgncngngtcttcatggccagtggtt

SEQ ID NO: 4803 - DNA, 293 bp, Zea mays
  misc_feature: Incyte ID No: 700349058H1
  unsure 2: a, t, c, g, or other
gnagctcagtacccgttttatggaggagcaacagctggcatggtgacaggaacaagccccttttatccatatttccaatttgggcagtcaggaaacactactaccaactatacaagtggacaaggctacaacttgcaacaatacccacaaatgttccacttctcaactgtatcttctacagctgcagctgtgaccggctttgctcagcaatatggaggaccattgtcactagcagcaagccctcaagcccaagcagtgtgtatccccattaaacaggcatgactatggcactc

SEQ ID NO: 4804 - DNA, 291 bp, Zea mays
  misc_feature: Incyte ID No: 700349059H1
ggaggccttggttttggatcaaacacgtatagctcgagaaacaatggtaggtggggagtcgtggataccaaatacaagcccagagggcgtttcaccttttggttttagtggtgagaaccaagacggctttaccgagttgaacagaggaccaaggtctggtggtttcaagcaccaaaaacaattcggtcctactgtaactattgctgtgaagggccaagccctcccttcagtggggaaacagaacagtgctcttccagacaaaggccaatttaaccaggaagggtttccttt

SEQ ID NO: 4805 - DNA, 289 bp, Zea mays
  misc_feature: Incyte ID No: 700349061H1
  unsure 49, 52, 54-55, 105, 132, 220: a, t, c, g, or other
tcccactcccactctccctttccactctcaggctcccactcacaccctnacngnntcgactacccatcacacacaaacagccactcctcacctcccccgtcctcnggttcatgtcctgctgctccccatgtngcccccactcgacctcgactacataggcctctcgccggcggggctgccgcgctggcccacgacgacctgaagggtaccgagctccgcnttggtctgccggggtccggttcgccggaccgccgtgttgtggctgccaccgcaaccaccctggacctgt

SEQ ID NO: 4806 - DNA, 278 bp, Zea mays
  misc_feature: Incyte ID No: 700349062H1
  unsure 70: a, t, c, g, or other
gatagatattagtatgaaagataaaaactagaatgctatgcctgtcagaggagctttcttcagtttcagntactgctctgctttattagtcatccagccgatggataatttctatacgtgtatcgcccctgcactttcaaacacatgttcattgtatccaatcacataatttttttcttctcttagatttactatgtggttggggccccagtttggtttgtaggttaatttgtatactcatgtgattttagtttttccgtgtattttatgttcattag

SEQ ID NO: 4807 - DNA, 290 bp, Zea mays
  misc_feature: Incyte ID No: 700349063H1
  unsure 20, 55, 57, 67, 78, 85, 216: a, t, c, g, or other
aaaactcagaaacccaactngctcgttcccgcaactcgcatcttctcgtcgacancncccaactccngaacccttgtngccggcnccggcgatgtcgtcatctaccgcccccgccccggcggcggcgatggccgtggacgatgcggaggacgaccagctcgcctccatgtccacggaggacgacatccgggcctcccgcctcctcgacaacgaganccgcgtcctcaaggacgagttgcagcggacgaacctggagttggagtcgttcaaggagaagatcaaggaaaacc

SEQ ID NO: 4808 - DNA, 289 bp, Zea mays
  misc_feature: Incyte ID No: 700349065H1
tttacttgtatagtaatgatagtgcctttacataaccactaaccagacacaacaaagcaatatgttctttcataggttagagatcatggggtctgaaactatcaaaggattagctaaaggttcaatgactacagaatggggtagggcagatccatgcattgatactggaaaaccagtatagtggtccctttttagattgaatgaaatgcagttgtgcagagcatgtgcattgctgcaactatttttatactgcttttttactgatattgctatggagatcaacaatttt

SEQ ID NO: 4809 - DNA, 286 bp, Zea mays
  misc_feature: Incyte ID No: 700349066H1
  unsure 151: a, t, c, g, or other
gaactttggcaagtttgatcccaagcgcctggagagctcggagccggatgatatcctcaaacccaccgtgcagtgtgacgagatattccggtacaggaacaaaatggagttctcgtttgggacgaagagatgggtgcaaaaagagttgaangacaagggtgaggaggtggaggtgaagcaggaaacgaatgaaactgatggatatgcgcttggactgcacgcaccagggttcttcgacaaggtgctacatgtgcagaaatgttttctgcagagtgagccagcagat

SEQ ID NO: 4810 - DNA, 285 bp, Zea mays
  misc_feature: Incyte ID No: 700349067H1
  unsure 3, 79, 81-82, 87, 97, 145, 246, 249, 251: a, t, c, g, or other
tgntgttgggcatccacttacagtttatggaaaaggtggtcaggtatgtctttgttatagcgcggtgccaaataactcncnncctcntcttttttgnaatatgtctatggttgaaattgttagtgtgcatcaatcagatcaatanttaaaatgtcagtggttgaaatcactactcgcattttgtcataaatcttgggaactgaaaaatcatgttagctctacctcaacaagtattgaaattgaatntgncntcttttcctgccaaatgctccaaaatagtgattt

SEQ ID NO: 4811 - DNA, 287 bp, Zea mays
  misc_feature: Incyte ID No: 700349068H1
  unsure 73, 231: a, t, c, g, or other
taggaagtcaaagaagcacaaacgaaagcatcaggatgacgagactgcctcaaatggttcttctggtaatcanattcgttttaggggaagataagaggacggaacaaagagtatttagttaccttggatttggaagaggacaataaatctgatatgtcaaagattgggaagaagacagatagcaagaagaagaggagaaaagagagaaatgatggtgttgacctaagacanaatacactagttggagagggcaagaatggtaagaataacaaagagaaaaaaatgtg

SEQ ID NO: 4812 - DNA, 282 bp, Zea mays
  misc_feature: Incyte ID No: 700349071H1
  unsure 25, 29, 31, 42, 46, 54, 62, 80, 174, 180, 215-216, 238, 280: a, t, c, g, or other
aaggtttcgagtcttacgacgatcnggcnangctacctttcngtcnctcctccncaacccangaacactgccggaagggncaaaaggggttcgaaattggtcctgatccaggagccaatcctacagacttcacctcccaaattcttttcccgatccgatctgcaagttctcctnggatcntgcatcctccagccgattcctgggaagatctgaannctcctctcgaccatggatccangcgccaggtatccttcgggatgggcaacggccgggtgggaantt

SEQ ID NO: 4813 - DNA, 282 bp, Zea mays
  misc_feature: Incyte ID No: 700349072H1
  unsure 65, 96, 184, 189: a, t, c, g, or other
acgaggaaagaacgctgataaacaaatggcgtaaatctctatcgacgaagctgtggaggaaaacnaaggatctccccgtgcttgtgcatgccagantcgcctgctctacgtccgcatcccgtccctcgcgaaactcggcactcccagggttcgtttctttgtttcacctactctcgttgtttangctantttgttaggcgcctttgcttcaggaaatggtgattgtatcgtactattctggggggaaagcgcaattatttgagggcaagttgattcatcatg

SEQ ID NO: 4814 - DNA, 283 bp, Zea mays
  misc_feature: Incyte ID No: 700349076H1
  unsure 2, 4: a, t, c, g, or other
ananaatctcgcgttcagctcctctccagtctctccgcctcccgcttacttctctgactctgtcctctttcgtttctttcttgtcggcgacggctggcggctggggtgctgcgccgctctcaccttcaccgccgacgagcattcacaagtagtggtctcttactggtggcggcgtagaggtgacgaaaaagccttgacaatgagcagcataggcacaggttatgatctgtctgtcaccaccttctctcccgatggccgcgtcttccaggtcgagtatgccacg

SEQ ID NO: 4815 - DNA, 283 bp, Zea mays
  misc_feature: Incyte ID No: 700349077H1
  unsure 14, 132: a, t, c, g, or other
ctcagtcgcctgcnccgccgcttcgttcgtgtggaggggagaagacaggaaatggcggcgactgagggcgtgctcttggggatgggcaaccccctcctcgacatctccgccgtcgtcgatgacgccttcctnacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaa

SEQ ID NO: 4816 - DNA, 283 bp, Zea mays
  misc_feature: Incyte ID No: 700349078H1
  unsure 27, 89: a, t, c, g, or other
cgcaaaatccccaaatccgcggcgganaggagagagccggagagaggggcgcacaagaggagatcggagaaggggaagaagatggtgcnggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaatgaatcatgattgtcatttgtccaat

SEQ ID NO: 4817 - DNA, 281 bp, Zea mays
  misc_feature: Incyte ID No: 700349079H1
cgtgtgcgcgtggatctctgcgtggaagcgatgaagattacggcgctcctggtgctgaagccgtcgacctctggagccgggagctcctcgtccggcggcgagtcgggcccggaggcggtggtgctcgcgaacgcgatagacgtcagccacttcggctacttccagcgcaggccgcccgcgagttcatcgtcttcgttgcccgcaccgtcgctcagcgcacccagccaggccagcggcagtccgtccagcacgaagaatacaaggtccactcccacaataga

SEQ ID NO: 4818 - DNA, 275 bp, Zea mays
  misc_feature: Incyte ID No: 700349080H1
ttcaagaactagaagcacatgtgtctatggaggtgcacctaagggtccacaaatacgggaccttagaagaggagttgaaattgtcattgcaactcctggccggttgattgatatgctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagag

SEQ ID NO: 4819 - DNA, 280 bp, Zea mays
  misc_feature: Incyte ID No: 700349081H1
gcagttcttacagtttctcaagcatcacagatagcaaggaacattacaacaaatgagatggcaaattccatgagatatgcatatctcagaggcccaggtggcagattcaggaacccgtatgatcatgggattcgcaagaactgctctgacttcttgttaaatggatacaatgaggacactgaacggctagaccagacattgcacactgatgaggagatgggaatgatacagatgacaagagcggtttcgcagaatggtgacaatcatttacatcatggta

SEQ ID NO: 4820 - DNA, 279 bp, Zea mays
  misc_feature: Incyte ID No: 700349082H1
  unsure 8, 47, 62, 104, 110, 113, 115, 126-145, 167, 181, 194, 200, 203, 226, 228,: a, t, c, g, or other
gtgcatcngcactgcaggggtctactgacgcactccaagtggggaantggcggaggcgactncattcgagcttggggcacgtaggcgtcgctcctgccatcgcngcagcngtnantggactctcannnnnnnnnnnnnnnnnnnngagaccattagttctcctgcgnggcggctccgcggntcccgccctctcncttacnttnttcccgctagggttttctccgancnccaatcactgctggttcanantngcttcatctcagnannnngagatggagg

SEQ ID NO: 4821 - DNA, 268 bp, Zea mays
  misc_feature: Incyte ID No: 700349083H1
  unsure 19, 62, 67, 78, 83-84, 142, 145, 213: a, t, c, g, or other
aatggattgtattcaagtngttcttctctgttgatgaatacattttaccaaatattcattanaatanattatacaagnaatannaaagattcaaatatattatgctatttttgatattatcataacaaataatgccgtagantanaacatatggaccccacatctttgaattgttgtccattttcaattttgaaatgatgacatctgaaatgngatatatgatttaatatctctactatatttaaatcaccagttccaacggtcgtcc

SEQ ID NO: 4822 - DNA, 124 bp, Zea mays
  misc_feature: Incyte ID No: 700349084H1
gagcattgtgcactcgtattgtgtttttttgaatctactttcatatgtttctgtccatcagaccgtgtttagaaactttgaaaagacagttctacagtgtttatgcaatgtcttatatcgaagt

SEQ ID NO: 4823 - DNA, 174 bp, Zea mays
  misc_feature: Incyte ID No: 700349085H1
  unsure 2, 5, 22, 33, 41, 77, 79, 93, 97, 105, 148, 151, 157-158, 160-161, 167,: a, t, c, g, or other
antanagtctatatagattganatttgtaactntggttttnagtattctttccttttagaaacttcctaatgattangnatatactttaactnttcngtgttcanaatctcaaagactaattaactttaataaacattcttgcaagtnccnaaaaannanngacaanaanggng

SEQ ID NO: 4824 - DNA, 277 bp, Zea mays
  misc_feature: Incyte ID No: 700349086H1
catctctacctttgagttgatgtgtataactgaataatagtgctgtgttttcaaaaggaaaggcttaaaaaacagtgcttctgtagtacaaggagggatgctctgctgaaaatctggaaattacagctaagcaaaaagatgaaaatacaaagtagctgttattctaccacccagagatcgatttgtttctttactaacagatacggcaagtgcctgttctgtgccaggcactgtctaggcactggagatagtgatgagcaaaaccatctcttctttc

SEQ ID NO: 4825 - DNA, 134 bp, Zea mays
  misc_feature: Incyte ID No: 700349088H1
  unsure 12, 16, 19, 29, 34, 38, 45, 47, 62-63, 65, 69, 75, 84, 91, 107: a, t, c, g, or other
ggctgtgtaatnctanatnagtataccangatcnagtnaaataananctttttaactagatnnangcanaagcgncgagccacnggtgganagcagaaaggcctggnggaagaagcgaaagtatgagcttggtc

SEQ ID NO: 4826 - DNA, 276 bp, Zea mays
  misc_feature: Incyte ID No: 700349089H1
  unsure 236, 258, 261: a, t, c, g, or other
cggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagangcggcatcccgagctggcgttntgntagaagagaaaaact

SEQ ID NO: 4827 - DNA, 277 bp, Zea mays
  misc_feature: Incyte ID No: 700349090H1
acaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagttaccactgctacccaggtacagggtgactacatgccaattact

SEQ ID NO: 4828 - DNA, 274 bp, Zea mays
  misc_feature: Incyte ID No: 700349091H1
  unsure 69, 80, 84, 86-87, 94, 192, 196, 199, 241, 254, 266-267, 271, 273: a, t, c, g, or other
ctgcttttaagcttagtaaccagggaccgaacgcctcggcgacctgctcgaccaggactaggtgcggcncgacctccagntcananncagcggncggagggagacgacaagcccatgggaccggcgagggcgaggaggacggggcctagaggaggacaggccagatcgtcggacccaaggccgccttccccngcgnacntcctactcccccgagcccgcttctcttaaaaattattttccnaatcagagaaganttgctatgtttnnggtntnt

SEQ ID NO: 4829 - DNA, 211 bp, Zea mays
  misc_feature: Incyte ID No: 700349095H1
  unsure 4, 6-7, 14, 22-23, 70, 84, 94, 112, 123, 134, 169, 171, 194, 205-206: a, t, c, g, or other
ttcngnncactttngtgttgtnnccatgtgtactccaggcattggttatagtcatgggaaaggaaggtgnccacggaggcacanttaacaaganagcatatgaaatcgcttngcaatgaggangtctgatgagnaagcagcctctccccatctacctagcaactgaatncntcaacaaccctaagtatggtcgnaatgctaccannctgta

SEQ ID NO: 4830 - DNA, 299 bp, Zea mays
  misc_feature: Incyte ID No: 700349102H1
  unsure 267: a, t, c, g, or other
ttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttnaaagactcaaaacttttttttgtcctctttgt

SEQ ID NO: 4831 - DNA, 295 bp, Zea mays
  misc_feature: Incyte ID No: 700349103H1
  unsure 225, 255, 262, 267, 271, 274, 287-288, 294: a, t, c, g, or other
gcaagagattgatgagctatgtgatgagtgggagccagagctgctatgccctccaatcaaggagggggccaaaatagatgctctaacattggaaagtgccgttggaccacctacgattgttaattgttgatggtaaagaagttgtgaactttgcatcagcatgaggtctggagtctagacacagcgttgcaaactgaggtttaatcatcttagcaactacggtangtgaccctgagcgcgtgattgttgcgaaanaacgacnacttnggtntanaccttaaaggttnncgcgana

SEQ ID NO: 4832 - DNA, 293 bp, Zea mays
  misc_feature: Incyte ID No: 700349107H1
  unsure 37, 51-52: a, t, c, g, or other
ggagccgaacgagcaagcaagccaccaaggaaggttncctagggccggggnngatggggttcatactgcgggtgaggctcgcctccttccttcgccggcgcggctgccgccgccaacgggcgggggctacttcctctacaaggactacaagctcgccaacgattctatggccctcaaggtgaaatgtctccaggactcaactgacactcgctacgaagcccttgaaaagcgactcgctgctttggaaggtcagcaaagcactgaggctgcaccggatgtggatacgccatcag

SEQ ID NO: 4833 - DNA, 288 bp, Zea mays
  misc_feature: Incyte ID No: 700349108H1
cagcaggtgattgggcttctgtcatcataaagtatgtattggacagagcaacagttctactcactgatcaccatgtggcttctaactacagcatgcggaatcgatctctatggcaggcatcattcgacgccttttttgggctgcttacacagtactgcatgagtaagtttgatcgtgtggttcatactgcccaattgcaacctgctgctgcaaccgttataaccagggaaatgccagtagagcttctgcgtgccagcctccctcataccaatgaggctcaacgcaagc

SEQ ID NO: 4834 - DNA, 291 bp, Zea mays
  misc_feature: Incyte ID No: 700349110H1
cacacacatagctacagttggacgagctatgtcatcttatgaagatgaagcatatgagatcatgcagtcacttgatgtgaactatgtgcttgttgtgtttggaggtgttactggatattcttcagatgatatcaacaagttcttatggatggtacgtattggtggaggagtttttcctgtaatcaaagagccagattaccttgttaatggggagtatcgtattgacaagggggcagcacccaaaatgctgaactgcctaatgtacaagctttgttactaccgatttggaga

SEQ ID NO: 4835 - DNA, 293 bp, Zea mays
  misc_feature: Incyte ID No: 700349113H1
  unsure 27, 37, 39, 65, 67, 71-72, 190: a, t, c, g, or other
cccgatccttcttccaccccgcacggncgtgccaggncnggcacgcggacggtgcttggactgcncntccnntggatcgcgccgagctcaccacggagcaggttctcaagcgagatattccatgggagcattacatgtcaactaagcttatctccggaacgtgccttcagcttttacggcgatatgacancaaaccggagagccagcgagctactttacttgaggaggatggaccagcatatgtccgagttttcctgaatatcctgtggagcatctccaaggaagagactgtt

SEQ ID NO: 4836 - DNA, 277 bp, Zea mays
  misc_feature: Incyte ID No: 700349114H1
  unsure 18, 21: a, t, c, g, or other
agcccaccgaattccctnacnattcctctcccattcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgaca

SEQ ID NO: 4837 - DNA, 297 bp, Zea mays
  misc_feature: Incyte ID No: 700349115H1
tgcctcgtcaccctcgagggtttgtcctcctgtgccaatttgaagtggctttcggttaaggaaaacaagcttgtgagcttaaaaggtgttgaggggctctcaaagctgcaggtactgaatgctggcaagaacgaacttacaaaaatggacgaggtcacatctttaacaagcctgggagcattgattcttaatgataacaatatttcttccatctgcaagcttgatcagttgcaacagttgaatacacttgttctctctaagaaccctgtctttaccattggcaatgctttggtcaag

SEQ ID NO: 4838 - DNA, 303 bp, Zea mays
  misc_feature: Incyte ID No: 700349116H1
  unsure 2, 135, 139, 146, 152, 183, 241, 245: a, t, c, g, or other
cncggtcgtaagggctgaggatttttggtccgcacgctcctgctcctgactcaccgctgttcgcttctcgccgaggaacaagtcggtcaggaagcccgcgcgcaacagccatggcttttaaggataccggaaaancacncgtgganccggangtggcaattcaccgaattcgaatcaccctancaagccgcaacgtaaaatccttggaaaaggtgtgtgctgacttgataagaggcgcaanaganaagaatctcaaagtgaaaggaccagttcgaatgcctaccaagactttgagaatcacta

SEQ ID NO: 4839 - DNA, 296 bp, Zea mays
  misc_feature: Incyte ID No: 700349117H1
  unsure 270: a, t, c, g, or other
ccaaaccaagctctctccggcgacggtgagggctcgatatcggagtccagtaggcggctcctgctgcttcggcggtccctaatccctctctcggcagtgtacagatggcgtccggcggtccggcgctcgagccgctcgtcgaccaggtcatctccgtcatcaccaacgatggccgcaacatcgtgggtacgctcaggggattcgatcaggccaccaacattatactcgacgagtcccatgagagggtctattctagaaaggagggagtcnaacaacttgttcttggtctgtacatt

SEQ ID NO: 4840 - DNA, 289 bp, Zea mays
  misc_feature: Incyte ID No: 700349119H1
gttactgtcaggaagctctgaagcaaagaccaccatggcctccacctacacagtgggttatgcatattgtgggtgctcaactcaggccaataccctggccatcttatggctctcgttcagttgggcaatgtttatgggggggtccaggttgtgatcaatgtttcttactgaatttcattatattaatggctttggggccttgctaaggcaacaggctaatctgtcttttgtcaagaagaaagggtggttggttttattgcaatttttatccggtggtcagcacaaccta

SEQ ID NO: 4841 - DNA, 289 bp, Zea mays
  misc_feature: Incyte ID No: 700349120H1
atgcagttgcaaactcatctaaatccaacccactaaaagcgccaaaatcagaagacgatcctctatggggtcttatagctgctgcaccacccaaaagcgcagaaaacctgcagacatcaagccatcaacatcacataacgatgaggatgacctgtggggttcaatagcggcacctcctccaaaatcatctggaaagcctttgaagccagctgcagcgaatagtgacgacctatggggtgccattgcagcacctccaccaggaaccaaagccaggcccttagcctcatca

SEQ ID NO: 4842 - DNA, 291 bp, Zea mays
  misc_feature: Incyte ID No: 700349121H1
cagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcagttcggattgtcatggggctttttgggaagactgt

SEQ ID NO: 4843 - DNA, 288 bp, Zea mays
  misc_feature: Incyte ID No: 700349122H1
cgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattt

SEQ ID NO: 4844 - DNA, 282 bp, Zea mays
  misc_feature: Incyte ID No: 700349125H1
aagttccgccttgagctctccatcgcggagacattgtcactgctagacctatgcgggaaggaaggcatctgagctgtcgaggaggtggtggtggttgccttgtgagcttctagtaaataccaatcatctttgtatgttttgtggatggtggttggcaacgttgtttatttatgcgcaagctgctgctggtttcgggatggaaggaaagacctggtccctgaaacaagctgcggagagtgagcctgtcagtgtattgtgtctggcgtggtcaagaaccaaatc

SEQ ID NO: 4845 - DNA, 288 bp, Zea mays
  misc_feature: Incyte ID No: 700349126H1
ccagagttgaatcctgggatagacttagctgttactgttttgacaacgggattctggccaagctacaaaacttttgacataaaccttcctgccgagatggtgaaatgtgtagaggttttcaaggagttctatcaaacaagaacaaagcacaggaagctgacatggatttattccttgggaacctgcaacatcaatgctaagtttgatgctaaacctattgaacttattgttacaacatatcaggctgcattgctactactgtttaatggatctgacaggcttagttat

SEQ ID NO: 4846 - DNA, 295 bp, Zea mays
  misc_feature: Incyte ID No: 700349131H1
  unsure 69: a, t, c, g, or other
agtcctcacatcgccatccttgacacgcgttcggagatcgacgtcgaaaccgccgcaccggagtccatncctcgccgtgttcgcctgcaccagagccgctcgccacctacctcttccatgccctattgagccgcgcgcccgtgccatctccgttgagatccaaggtgagcatcctcctcgtcgcctcctcccctctaccatccccttcccttgaacataacaggccctacagacagattccattttagtagaagcggtggatcgacaactgcgcctcgttggtctatcttttgtc

SEQ ID NO: 4847 - DNA, 226 bp, Zea mays
  misc_feature: Incyte ID No: 700349132H1
  unsure 57: a, t, c, g, or other
ggccatattaacagctgcgcgtgcacggtggagttctacttccgcccgcgattcgancgctcgttccgtctcgaccttcaggcgggtagcaggttgaccgtccgggaattcaccgtatcccgggatacgtatgggttccaaagcgtccttctgtgtcacgctcctcttgctgctcgccgccgcctggggacctgccgacgatgctgctgaatcccagaccatagag

SEQ ID NO: 4848 - DNA, 293 bp, Zea mays
  misc_feature: Incyte ID No: 700349133H1
gcggcggcggaggatgatcaagaacagggagtccgccgcgaggtcccgagcgcgcaaacaggcttatacaatggagttagaagccgaagttcagaaactcagagagcagaatcaggaactggagaggaaacaggcagaaattatggaaatgcagaacaacgaggtatcagaaatgttgaaggatccattcggacggaagaaacggctgtgcttgcgaagaacgttgacggccccctggtgacgattgcctagaacagcacatgacttgcacttgctacgtacctgcaggggcg

SEQ ID NO: 4849 - DNA, 289 bp, Zea mays
  misc_feature: Incyte ID No: 700349134H1
gtttgatgaatgaggataaacgctgccgccctatactcttccactctgatggtccgaatgcaggagatcaagaaccattccctgtgggatcaaatgtccgttccaggcctggaaggtccaggattttgagctgggaacaaaaccaccaggacattgtgtctgatcataccaaaggtggaactccgagcagggctggtggcactccaggttacatcgccacggatactgatcatacggctgttgattgacgaacttgcgacaacacccgacattctgacaattgcaatcc

SEQ ID NO: 4850 - DNA, 285 bp, Zea mays
  misc_feature: Incyte ID No: 700349136H1
tgatgtatatagctttggcgtactcataatggagatcatcactggtagatctcctgtagactacacaagagcagctggagaggtcaacttggttgagtggctcaagaccatggttgccgagaggaaagcggaggaagttctggacccaaagatggctgaaaagccttctcccaaaacgctgaaacgggcgctcctggtcgcgcttcgctgtgtcgaccctgatgcgaacaagaggcctaaaatggggcatgtgattcacatgctcgagatggacgatctcctctt

SEQ ID NO: 4851 - DNA, 285 bp, Zea mays
  misc_feature: Incyte ID No: 700349137H1
  unsure 14, 173, 224: a, t, c, g, or other
catgtcgacgtcanaatccatttgcataaaatgtgatccttcagaatctgatgttacatgggaatggatggagaggtggacaaccttaattccaccaatcactgtggtgcacgtgccagagcataaagaaaatagtgagttgatgggtgaaactgtgaccgaacaagtgactnaacatgctcagtgtgatgaagacattgttgctttggactcagacatatgtntccccaagttggtggctgatgacgtgaaagaaacagtagagacatctgaatctagtacctt

SEQ ID NO: 4852 - DNA, 288 bp, Zea mays
  misc_feature: Incyte ID No: 700349139H1
  unsure 10, 25, 56, 185, 192, 200, 213, 216, 219-220, 225-226, 230-231, 245, 249,: a, t, c, g, or other
agtacttgtnccgccccacgtcgcnccgccgtgtccctctcgccttcttccccacnccaccctaccctggcacccacgcgctcttcagatcagatcggcaaggccaatcccgagcagtggtgcgaaacctcgagcgctcgcgccggtgaccataacaaagaggaagccgcggttagaattggtancgggaanaagttaanggggaagaatgtngtnggnnttaannggcnnatgaagacggcccntttnttngnnttcnttggggcttcggtngggttngttttttaa

SEQ ID NO: 4853 - DNA, 284 bp, Zea mays
  misc_feature: Incyte ID No: 700349141H1
  unsure 235, 242-243, 246, 276: a, t, c, g, or other
gcagcttaggttaaaatcaaaaaaatttgtcgggcggataatacaaggcctacaccagaaggaacaccctttgtgcgacaggcgaacagctgtctctatctctctctgcagtattatttggttcattatatgcagttgcaggggagaaaactaaggcatgttcactgcagctagaagcacagccgcagcagatgcagcagggcttcttaatagtattgcagcttagaagttgganttggcanntgncagctagctgcagcaaacattctaacattnatggtggg

SEQ ID NO: 4854 - DNA, 205 bp, Zea mays
  misc_feature: Incyte ID No: 700349145H1
cgagcgagatccccctctcccgctgccggatccgatctgacctgacctcgtcgccgcctgccgtgggagggagaagaggaagaggaggcggaggcggcggagatggcaccggtgtcagcgctcgccaagtacaagctcgtcttcctgggggaccagtccgtcggcaagacgagcatcatcacccgcttcatgtacgacaagttcg

SEQ ID NO: 4855 - DNA, 285 bp, Zea mays
  misc_feature: Incyte ID No: 700349146H1
  unsure 19, 24, 30, 34, 89, 94, 98, 101, 128, 150, 155, 166, 180, 182, 235, 258,: a, t, c, g, or other
gagtggtcaagtccgaggncaccngcccangggncagacctcccccgccacaacgcgagccgcatcgcctcgtctcctccacgccatanacgcncgcnttnccttccccggcgaccaggacccctcgnccgcggcgccagcgagctcccncggcnagtcgtaggcntcccggagctcagnangcacgcaggtgggtccagtgaggcctggttgtgcgcgttcctgcgggcgtcgncggggcagatccatggaatcagncgnncgcagngcgatagtatgcattgt

SEQ ID NO: 4856 - DNA, 289 bp, Zea mays
  misc_feature: Incyte ID No: 700349147H1
  unsure 191, 284: a, t, c, g, or other
cacccatattccattttggttatcctcttgcgtcacacctcctccctcctggcctcctcctgcggcccacttatatataccaccacgtcgatgcgctgctccgccggcatctccatcgccgtcgcgccgccgtagatggcctgacatttttcacttcatttgtcatcccaattccacaaacctcgcgcgtngcggcggagggaaacaaaaaaaaaaggaaggatggcgttggagccggtggcgcgggcggtggcggaggaggtggcgcgctggggcggatgcgnagacc

SEQ ID NO: 4857 - DNA, 297 bp, Zea mays
  misc_feature: Incyte ID No: 700349148H1
  unsure 153: a, t, c, g, or other
ccctaaaccctagctgcagtgccactaccgcccgcttgcccggtctccggagaggaagccgacccaagcaacgatgccgtccgggtcagcgacgcaatttcggtacacgcagacgccgtccaaggtgctgcacctgcggaacatgccgtgggnatgcaccgaggaggagctcgtcgagctctgcaaacccttcggcagggtcgtaaacaccatgtgcaacgttcggcgccaaccgtaaccaggcattcgtcgagtttgcagatcaaaaccaggcaatttcaatggtgtcctattatg

SEQ ID NO: 4858 - DNA, 467 bp, Zea mays
  misc_feature: Incyte ID No: 700349153H1
  unsure 74, 162, 167, 324, 363, 369, 376, 388, 412-413, 416, 445, 457, 462: a, t, c, g, or other
gctccgccctctcttccttacctcgctcgtctctctccttgagatctccagggtacgagccgcattcgcgattntggccgctccgccgccgtccgggaagatggcgggtctgggaaaggcgatgtacgcggtggggttctggatcccggagactggccaagnccttngaccgcttggcctgccgctgcagggcaagtacttcttccacgagcagatttcaaggcatcgcaccatcatgaatatctttgacaaaaccctcatgtgcataaagacgcatttgttgtccaagtgcatccttattggtgatgtcaagtcggtcagganttccattgtatgggtgcgtcttaagagggatgcaaacancatacnaattggnctggaccatatncagcaatctctatcatgtgctaanntantaatggaagcttccacaccatgtatacgnacatagcatatntggtncagag

SEQ ID NO: 4859 - DNA, 364 bp, Zea mays
  misc_feature: Incyte ID No: 700349154H1
  unsure 110, 132, 148, 160, 165, 167, 178, 195, 198, 215, 242, 244-245, 250, 255,: a, t, c, g, or other
gtcagctagttggacaacatcacgtgaatcacattaagcagtgtgagcatgatatgtttactcctggtgatctctcttatgtgatatatgaacacttgtgggattcttcngcaccatggtggagcactgtancaccggcttgatgtgnagaggaaccatngaagngnctcccattttnagcagattcactatatnacntgaaatgctatgagaangactgacaattgatccttgagtgtgtnannctatntagtntncagtagngtaccancanatntgnaagtgnctgcagtatnaaagngctgncatggtgtnnnccagtnaanatggcacagnaggccaagngtcagacttcgnntncang

SEQ ID NO: 4860 - DNA, 334 bp, Zea mays
  misc_feature: Incyte ID No: 700349156H1
  unsure 6, 8, 24, 36, 66, 68, 70, 72, 77, 79, 82, 87, 91, 96, 101-102, 107, 142,: a, t, c, g, or other
aagtanancctacctgatcccacnagcgcggtagantctgctcagcagcacacttcgacgactgcngngncngtcgncngtngctgncgtntattntgacnnatcgncgggacgataatcgacagtttgtggataatggtcnttaagtnttatatgaaataacgtntggcngntngntgangagaataactatcatgtntgtatgcnnattcagangtgcaaggtgagatttaacttatggcgatgatgcnnaagcnncaagttcgnagtangacttangtcatccatnagngatagtcatgcattctggcancggcattgagcanaataagat

SEQ ID NO: 4861 - DNA, 364 bp, Zea mays
  misc_feature: Incyte ID No: 700349160H1
  unsure 30, 49, 103, 146, 156, 159, 178, 197, 202, 212, 227-228, 232, 237-239,: a, t, c, g, or other
ggtggtttccggttaggagccgtggtcttnccgtgcagaagtgcaagantgtggacgtcaaggatcatgtgtcgactgaacccagcagattcgaagaagctangaattcggtgactgaattgtgacccaaagacacaacagccatncagagtcttnttngataccacgaggtcgaccnatgtgaatcatgcactatncatgncaacttcatnttcagatgctgggtnncttntgtgnnncannagacctntaagccaccgtgactctacgaagcctanggctcttgantataccncntnngcantgtgantnnataaagatgatgaaatcnncaagtcgtccggtanaggtgctatcnaggaga

SEQ ID NO: 4862 - DNA, 371 bp, Zea mays
  misc_feature: Incyte ID No: 700349161H1
  unsure 227, 257, 275, 279, 281, 291, 298, 304, 313, 322, 325, 330, 336, 347, 365,: a, t, c, g, or other
cagcagacacctccgccactccacctcgaatcgttccccaccatggcgtcgcagggatcctccgtcttcgccgcactcgagcaggcccggaggaccccatcctcggagtgaccgttgcctacaacaaggatcccagccccgtgaagtcaactcgggtcggcgcttaccgaccgagaaggaagcctatgtgaactggtcagcggcgacaaatgtgtcatatcgtcagntcaagatactacatcacgttgtgatcatantgacgtacttattggtgnactntncagaatagtntcgcatntacggntgtttagangagtatctnagntaagngatatncaacactgganacaactactatgtactantngata

SEQ ID NO: 4863 - DNA, 433 bp, Zea mays
  misc_feature: Incyte ID No: 700349162H1
  unsure 146, 165, 230, 242, 259, 293, 298, 302, 305, 308, 344, 352, 356, 362, 370,: a, t, c, g, or other
caacaaagcaaaggtacggccacaaccaccggccaggaagcaagctcaaaccctaaccgccggcgacgccagcacgatggcccgtacgaccgcgcgatcaccgtcttctcccccgacggccactcttccaggtcgagtacgccctngaagccgtccgcaaaggcnacgccgcggtcgggtccgcggcacggacaccgtcgtcctcgtgtggagaagaagtcaaccccaantccaggactcangtccgtgcgcaagatcngtgcctggacaccacatcgtctgcatcgcgggtngagcngacnacngtntcatcaacggcgcggtgatgcagacaacgatcacgngagaccgnacgngataanaccgtaangtggtcacaagttnnaatgtgatcgcttngtnncaatatgngtcgnctancnaacagtnacaa

SEQ ID NO: 4864 - DNA, 436 bp, Zea mays
  misc_feature: Incyte ID No: 700349164H1
  unsure 87, 105, 112, 135, 139, 151, 153, 156-157, 164, 166, 168, 171, 173, 199,: a, t, c, g, or other
ggtactactctcatattgaggaggagagacggcattgcattgtgagagagtaaggacatgatagtgtagagtggactaaagaaggtnccttggatggtatctganacacaancgtctagtcccatacacactgangcgnatcacgctaaantngcnnaatctgnantnatnanactggagagaatgaagggacgtcaancgacaagtgacttcgtagggtttacatgcagtaccttgtattcgttggctcccaggaaaaaaaagtgagctggncacgtcangtgncacctcagtttntgaaantgtactantngatagantatagatngctaccagaaagatcccatatggttgntgccatccatgaaggcatgatacacgacatgncccgnaatgtggtgctangntgcggntgacaggtnatggtatganacgg

SEQ ID NO: 4865 - DNA, 478 bp, Zea mays
  misc_feature: Incyte ID No: 700349165H1
  unsure 125, 159, 203, 252, 352-353, 429, 444, 476: a, t, c, g, or other
gctcgctgcacgctctcgctcgcgggtcctccctccactcggtccgccctctatcgcaggccctggagccgaacctcggctctccgtactcctcctccaagtcaagtggggacagtattggggangaggcctgcgcatgttccttgaggacaagcactncaacgggatttcgtcaccaaggtctctgacatggtctggaggangaatggcgcccatgttggtgcggtgaggcgaccacgggccaagggagtncaatagatgttgtcagcctgaagacgtgcgggaagatgctgtgggacgaaggaatgttgagactagcggcgttactagtgatgggtgtcggtgacagcanncctcctttaaccagagcttctgccgaggaaagcagacgagacaacaaaagaaggactgatctttgaatatgaaccntcaagatgatttctntcttgacgcagactgacacatgtattatatgntc

SEQ ID NO: 4866 - DNA, 427 bp, Zea mays
  misc_feature: Incyte ID No: 700349166H1
  unsure 5, 9, 14, 24, 32, 34, 41-42, 66, 76, 79-80, 91, 106, 108, 143-144, 152-153,: a, t, c, g, or other
catancgangcagncacattccanacaacatncnaactagnngtccgacctccgttcaagatgcanatctttgtgnaanntgactggcaanactatcaccctcgangnggatcgtctgacaccattgacaacgttaacgccannattcagannacgangnnntcccccccataccagcancgattatttcgctngaaacagttgaggacngngnaccttgtgatacaacatccagaaganagcacnctcnacttgtgctccgcctcagggggcatgcagatttcgtgaaganctgacggaanatatcacctgagtgnagcntnganaccatgcaantnaagccagtcagacnagaggcatntnnnacacacgngtttctgcacatgagatgccagttcgtaaancnaagggactcatgtntgntnag

SEQ ID NO: 4867 - DNA, 399 bp, Zea mays
  misc_feature: Incyte ID No: 700349168H1
  unsure 3, 17, 20, 30-31, 82, 126, 146, 151, 209, 241, 251, 259, 294, 300, 304,: a, t, c, g, or other
gcntctcgtagtggcgngcntcgtgcgtcnntccactggtggtggtagggagtgcagcggatcatcccgtgtcccgatccgngtccttcgtgtagtatcgagccttgccatcgtgtcaccgaagangattcatcagtaaagaattntttancacactacaatataaggaaagaggttcacgtggatacaatcccggtctccttgttgcnaatagggtaaagttgttgcaaagacatctgtntgttgaacangcgcgctntgcatgagaccagcatgatgcccaagagtatctgnagaatngagnactgtatatttgcaccgtgattncattccttggagaagcatntnctctaatatgacctgatgagncnancatatcnagcnncnagctnnacnaca

SEQ ID NO: 4868 - DNA, 362 bp, Zea mays
  misc_feature: Incyte ID No: 700349173H1
  unsure 8, 37, 74-94, 125, 158, 170-171, 175, 204, 214, 247, 252, 255-256, 264,: a, t, c, g, or other
gctctggntggaagtttggagaactccccggctcgangagatcgtgacattgagatgacgatgggaggcgcggnnnnnnnnnnnnnnnnnnnnntcggcgtggtcttcagatccacgcctccgantcgtgctgtacgagccgttcgatgagacttganggaaatggtcgnnccanaagatgataccagtgtgtggagcatgcanagtatgtcanagatatgctcctgtatggagcatgaatcgcatncaganttnnacagtacntaagnggaatgctnantaatagntcaatgctatcgagtctaatannncgccagantgtgtcagatgtaggncncttnttgcanatggnacnagntnct

SEQ ID NO: 4869 - DNA, 487 bp, Zea mays
  misc_feature: Incyte ID No: 700349175H1
  unsure 16, 25, 27-29, 58-59, 72, 93, 95, 100, 103-105, 108, 112, 126, 135, 159,: a, t, c, g, or other
gtgatgtatcaccgangcgcggatngnnnacgagatgcctcgtctcgcctatgcttgnnactcccgccggcnacgacacgcgcgatgaggatnanatcancannncgnatgntcatgtggagaganacgccgcgnggatggacgctgccctcctcatgncgactacggcacgatggccganttnacaccggggtcgatctggatcnactgcaagtggaagcggcatctcgggtcaagngcctccanaagacagctacaaanaaggagatcgtgncggnaagagtcagcaggtccagcatcngatgttatctattcctttgtgtntctatntgatctgtntnnttgcnngcgccacaacagagnagangtggtcgtngctgtaatgggtcaccaagtacaccatcnannncancattcccttgngttctgtttganctattnnttaaaattcntancagttgataccaccatngaaccgtcaagtttg

SEQ ID NO: 4870 - DNA, 477 bp, Zea mays
  misc_feature: Incyte ID No: 700349178H1
  unsure 2, 5, 162, 167, 176-177, 349, 394, 400, 413, 437, 464, 466, 476: a, t, c, g, or other
anagncagatgtaagtcttcgcttcgtcatccaccgagaacgtcagggcgcgtaattcaggatctactgcaaggtcagccgctccaccaccgccaccaacacatacagacagtgccgtcaaccctttacggttcgacgcacgcactatacatttctccatcnacggntggatactnngggttgctggtctgggaatgttcctattttgccaaaacaccttgccgacagagttgcaaactttcacttctgggaacaatattgtcatcagggtattctctatacagtacttatgggaaaccaagagcatggaacatgccagcaatcaagcttggttgcagtctatattgcnacaaaggattttatccattaatgtctctctagctcttcacatccnattgcnttgaagatgtgcntacctgtgcttgtggcgctgacangtgccagatcttaagcgtatttgccgncncttctatagng

SEQ ID NO: 4871 - DNA, 175 bp, Zea mays
  misc_feature: Incyte ID No: 700349180H1
  unsure 171-172: a, t, c, g, or other
ggagggagagagaggagacgatagggactttcgtacggggtcgttcgcttgtgggttcttcctcctggcttcattaaggtggactaatggtagaacaatgttgtcaatctcagtcgaaatcagtgtgaatatgtcgtgattctctctaatctaactaactatatataatgnnatt

SEQ ID NO: 4872 - DNA, 421 bp, Zea mays
  misc_feature: Incyte ID No: 700349181H1
  unsure 3, 9-10, 49-50, 57-58, 77, 86, 147, 249, 288, 327, 331, 335, 349, 352, 367,: a, t, c, g, or other
cgnactcgnncgcctcacttccagcccaacggaccacacaagggcctcnncatgtcnngaagtaggacgagcgaagnaagccagcnggcggcggcgagtgtcccgttctggagtcgcatctccagaccattaggacacttccagatnttggcgattcggctccgggggcttggagcggacggagtggtctgaggtcgttaagctcggcgaccagtctccaggcaggccaccgtcgtggaatgtctgganggtgattgctgtgtagagacctcaaagagaacatcgttnctattcaacatctacaggattcttttgttgccacgaaanatgncgtntgggctattaacantcnactttggctcaaaangtgtgattantccatgtcanatctgctctgtaganganctacgaaaatnaccag

SEQ ID NO: 4873 - DNA, 434 bp, Zea mays
  misc_feature: Incyte ID No: 700349182H1
  unsure 96, 162, 262, 288, 314, 316, 331, 337, 352, 355, 360, 362-363, 367, 396,: a, t, c, g, or other
cattcccgagtctccagccaccgcatcaagtccacccccatcccctcgaccccgacaaacccgacccgatggcgcccaaggccgagaagaagccancggagaagaagccggcggccgaggagaaggcggagaagacgaccgaagtaagaagcccagttccanaaccgcttgccggcctcgaagtcctccggcaaggagggcggcgagaagaaggggaagaagaaggcaagaagagcgtggagactacaaatctacatttcangtctgaagcagtgcacccgacatcgnatctctccaaggcatgtccatatgantncttatcacgacattngagaantcgcgcgagcgcaantcngcgtnannaganccacatactccgggtcaactcgtggctcnctccaggatccaanngcgctcgagacaagctacaatna

SEQ ID NO: 4874 - DNA, 463 bp, Zea mays
  misc_feature: Incyte ID No: 700349183H1
  unsure 5, 9, 55, 64, 130, 162, 170-171, 296, 338, 373, 378, 388, 438, 446: a, t, c, g, or other
tcgantcgntgccgtccacttgtctcacggctgtcgccatctccttcctggtttntcatccgancatccccggctcctccgcgccgtcgggacgactccatcgagtcactcggccgcagcaaccggcgancatgtaccgagtcgctctgggctcggcgcctnaagaaggnntggggcaaatgtcaaatgatgaatgtgcaattagtgtgccagcacaagtgttgcacagaggtcttccggtggttctggactggttgactggtgcgcgttcaatgaatacctcctccagattcacnttccgggagtgatattcctcctccgctgctgacatgtggagntggcaaacaagagtcacacattcccatggtgttanaatanctctgagacnctgcgggatcatcttgtctgttgagttatgtgatgtggtctgatatgaanactgaacnaaagcgcagtccactgt

SEQ ID NO: 4875 - DNA, 400 bp, Zea mays
  misc_feature: Incyte ID No: 700349184H1
  unsure 10, 39, 64, 72, 81-82, 102, 120, 125, 157, 172, 201, 218, 227, 236, 238,: a, t, c, g, or other
ttcattccantccacttggatcgatcgatcgcatatggnggtactgtggtggtggtcatcgtcntgcttgtnctctcgcgnngtcgctgctgcgctgtttgntgctggtggtcacggcancgatngaacaagcacaacagcacaatggcggtggaantgtagttccacaagnagaaagagccacaagcaagcgaggggacnagccatgctggcgaganacgtctccnatcggctcntntcggcgctgcaanacacagnacgagacggtgctgaacccgnnacatgtagttgccgangtctgtcganaaaacgnggcntcgntcaagggnaantcaacttcnggnttattctggcacggcattnagnggaagaggcnttacaatcgtaagcacntttcngg

SEQ ID NO: 4876 - DNA, 430 bp, Zea mays
  misc_feature: Incyte ID No: 700349187H1
  unsure 31, 243, 300, 351, 369, 391, 415, 425: a, t, c, g, or other
gcaatctctagcagcagatcctcgtgcgaanaaagcgctaccccttcgtactgtcccgatggcccgcacgaagcagacggcgaggaagtccactggcggcaaggcgccaaggaagcagtggccacgaaggcggcgcgcaagtctgcccggcgaccggcgattaagagcccaccgtttccgcccggcaccgtcggctccgggagatccgcaagtatcagaagacacggagtgctgatccgcaantgcgttccagcgcctgttctgagatcgcccaggattcaagaccgacttcgttcagantccgcgtgctggctgaagaagcgtcgaagctactgtcggtcttgagacacnactctgcgcatacgcaanggtcacatatgccaagaatcantgccgcgatcgtggaaagctaggngtccgtgagncaata

SEQ ID NO: 4877 - DNA, 159 bp, Zea mays
  misc_feature: Incyte ID No: 700349188H1
  unsure 3, 20, 34-35, 42, 53, 57, 65, 70, 79, 82, 92-93, 107, 129, 146, 152-153: a, t, c, g, or other
ggntcttctgacttctccgnatcagatgctctcnnatcatanagctgccagangtgngctacgtncacgncggctggcnacnaagcaagatnngatatggttcgaanccgagagctgtgttacgtcagntgcagtactgcaacacngtaggnncggttg

SEQ ID NO: 4878 - DNA, 432 bp, Zea mays
  misc_feature: Incyte ID No: 700349189H1
  unsure 74, 85, 221, 297, 323, 331, 333, 340, 347, 353, 377, 381-383, 396, 408,: a, t, c, g, or other
ggacttgcagcttggattgtagagacgacgaacaaaggcagaagatgtggagagtcaaccaacgtatagtgaanttatagcggantcatgaggaaccatgacagcctgaagccttggtgatactcgctagtgttctgacttctacttcgtgtactgatggaatgcttgttgacggtgaagcttgactttgccacagttgagttctcgaagtaaccgtcgancagtccatcttattattgaatggggagatccaggttatcagttgtgatggctttctaatctgtaaagtgccgcttncaccacatccgtgctttctcaccaancggacgtngnggctcanatgtcgnctcggncatctgacccacgatcggagccanaagnnnaccgaggacacanggatgcatcaancangacgtngtgcgagactnatgg

SEQ ID NO: 4879 - DNA, 435 bp, Zea mays
  misc_feature: Incyte ID No: 700349190H1
  unsure 5, 20, 24, 44, 46, 59, 74, 78-79, 84, 126, 155, 159, 163, 170-171, 176,: a, t, c, g, or other
cgcanctcaggaacagacancatngtgcactaactgatgctganangctactgttaatngctgtggggaaaagngaannctgtngagattggcgtgagtccttgccagtctgctgattgtctaccnttggacccagacgtattttctaaaattgnggantggnctctgannctgcnatcatgggaaaccccaggtgaaggccatggcgaaaagtgtaacgccttcgatgtggctganacattngacaacctcatggcactttgccanctcagtganctcgntgtgacaagtgatgnggatctgagcacttcagctcnggnnatatnatttnanatgatgngcacaatgggcaggaatcagncgattcacagntgcgttcagaagtgtgntgatnccatgcctgctcagatacataacnntncntntgtgcttgga

SEQ ID NO: 4880 - DNA, 324 bp, Zea mays
  misc_feature: Incyte ID No: 700349192H1
  unsure 36, 52, 96, 124, 137, 145, 149, 176, 229, 233, 237, 246-247, 261, 263, 281,: a, t, c, g, or other
gagcgggtgatggtgggcttctcgggtcgttcgggntccacagggtcacgcncagggatctcatgtctccttcatcggcaccatggtctgcgtganggatcgtcacagatgtcatggaaggcanagtgtaagagttncactttgnctgnactgggcttcttcgcggatatgagcanatctttgagctctatgcctgttaccacaggagcaggactgtgcacgaatgatnggantagnacagctgcnnagatctaatgctgnantccagttagataaggctnattcactggcggcattggnagcnccagacagannngtnantct

SEQ ID NO: 4881 - DNA, 434 bp, Zea mays
  misc_feature: Incyte ID No: 700349193H1
  unsure 26-27, 34, 58, 129, 131, 252, 290, 315, 343, 352, 358, 360, 362, 372-373,: a, t, c, g, or other
cagacagcaccagcagcctcgtcggnngcggcantgcacttcaccagccgccgcttcncgtctctctgctctgcctctccccctaaccccttccatttctccacccaccccgtcccgttccgttctcgnanttagttcgtccgaaccggaagcggggctggttcgcattgggggcacgcaatggagcagtacgagaagtggagaagatcggggagggcacgtacggggtggtgtacaaggcgctggacaagncaccaacgagacgatcggctcaagaagatccgctcganaggaggacgaggcgtccgtccacgncatccggagattctctctcaagagtgancacgcacanctcagntncngatgtgtcannacgagaangatatacttnctcgatactgantgactcagantcatgatctgccgnttntaga

SEQ ID NO: 4882 - DNA, 295 bp, Zea mays
  misc_feature: Incyte ID No: 700349201H1
  unsure 278: a, t, c, g, or other
ggcctgccgcctcagtgggacgaaactcactggctccctctccttcccccagttccgcggcgctcgctccgttcaccttcggccgcggcgaccttcgaggcgacgagacgatgctgcggctctcccgcttcctcccctccgcctgcaggaggggttttgatctaaaagaatctctttggtgtggttcattgacattccaacaagctgtttccactgcagcaacaaatcttgatgggaattgtctggcaaaaagttgcaagttatacggtgttcaaggnaaggtgcacttctatac

SEQ ID NO: 4883 - DNA, 286 bp, Zea mays
  misc_feature: Incyte ID No: 700349202H1
  unsure 37, 45, 55, 94, 96, 116, 134, 142, 154, 163, 182, 199-201, 203, 205,: a, t, c, g, or other
gtgaatcaggcgtcggagggccccctcaagggcatcntgggctanactgagcacnaggtggtctcctctgagttcaacagcgacacccactccncncacctttgacgctggggctngcattgccctcaacgacnactttgtnaagctcatttcntggtatganaacgaatttggctacagcnacagggtggtaaaatcnnngncncanngctncaangntaaganncctggacnacngcnccagcaagagcaccngangaagagagagacctcatgctgggancct

SEQ ID NO: 4884 - DNA, 279 bp, Zea mays
  misc_feature: Incyte ID No: 700349204H1
  unsure 2, 14, 19, 29, 34, 40-41, 46, 60-61, 109, 115, 127, 133, 144, 147, 164,: a, t, c, g, or other
cnccactttaccgngcttncaagtgggcnatcancaacannccacnttatctgcctatgnnggtttgcaagatagttgaaggacagcgttactcaaagcgactcaatgngaaacnaatcactgctcnactganagtgacctgcnagngccctcaagagcgtgantggaccatttacagactncgcatcacaatncgtcctatgggnancgtatncncnngaattnngtatgagaatttctgaacgccntgntgnattgaatntcgtgttctnncagcaa

SEQ ID NO: 4885 - DNA, 73 bp, Zea mays
  misc_feature: Incyte ID No: 700349205H1
ggattaacctagtaaaaaacttccatgttccaggcctatgctgtatgatatgtgacagcatgatgttctggtg

SEQ ID NO: 4886 - DNA, 286 bp, Zea mays
  misc_feature: Incyte ID No: 700349211H1
  unsure 53: a, t, c, g, or other
cgtcctctcctctccgtacttcctccgcagctacccccatcacattcccaaanccttcgtcgacccctcctcctcgatctacaccggcgatcggcggcgagcgatggggtgggcgacgcggttcctggcggcggtgtgcttctttgctgcgggtgtcctcttcgtccccgaggctctccttggttccccctccggcgcaggcgccgtcaccgccgccaagctggcccacgtcctctcctttgccattcctggggcgccgcctctgggccactttatcggcggcata

SEQ ID NO: 4887 - DNA, 289 bp, Zea mays
  misc_feature: Incyte ID No: 700349217H1
ggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccatggcatctggggaatacacccttgcaactgggggtgcatagttcg

SEQ ID NO: 4888 - DNA, 287 bp, Zea mays
  misc_feature: Incyte ID No: 700349218H1
  unsure 68, 138: a, t, c, g, or other
cgaggagagacagatacagatcgcgcgctcagatgtcgtcggactcctcgtcgtgggcgcgcgccctngtgcagatctcgccctacaccttctccgccatcggcatcgcgttctccatcggcgtctcggtcctcggcncggcatggggtatcttcatcacggggagcagcctcatcggggccgccatcaaggcgcccaggatcacatctaagaacctcatcagtgtcatcttctgtgaggctgttgcaattatggtgtaatgtggcaatcatcctccagacaaagct

SEQ ID NO: 4889 - DNA, 288 bp, Zea mays
  misc_feature: Incyte ID No: 700349219H1
  unsure 185: a, t, c, g, or other
cccggctcccccacggtactccagccgctaccctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcantgacgatgggtatcctcgatatcatccagcaggccgccaactacaaacagcttaagaagggagcgaatgaagcgacgaagaccctgaataggggcatatcgga

SEQ ID NO: 4890 - DNA, 283 bp, Zea mays
  misc_feature: Incyte ID No: 700349220H1
caagagaaagaatgtaacctatagaggaaagaaactccttccattgttcgacgatgctaccgtggaagctggaaacgtcccccaaggtaatgatgcacagcattcaacagaggtcacactggaccttgctagagagcaacataagcttgcaattgccaatgaaatcgatcaggtacacgagaggctgcatgctcttgaggcagatagggaatacataaaacagtgcgtgaggactttgaagaagggagggaaaggtttgatctctcaggagtattacagcatc

SEQ ID NO: 4891 - DNA, 156 bp, Zea mays
  misc_feature: Incyte ID No: 700349222H1
  unsure 153, 155: a, t, c, g, or other
cgctgtaagcagctcattctgtgaccccagctacgtaaaagatcgggtagaaaaagtgggccaggtgatcagagttatttgcatcctcagccaccccattcaagaacaccaatgatgccaacttcctgccagattcattattccacacaacanang

SEQ ID NO: 4892 - DNA, 284 bp, Zea mays
  misc_feature: Incyte ID No: 700349224H1
caagagaaagaatgtaacctatagaggaaagaaactccttccattgttcgacgatgctaccgtggaagctggaaacgtcccccaaggtaatgatgcacagcattcaacagaggtcacactggaccttgctagagagcaacataagcttgcaattgccaatgaaatcgatcaggtacacgagaggctgcatgctcttgaggcagatagggaatacataaaacagtgcgtgaggactttgaagaagggagggaaagggtttgatcttctcaggagatattacagca

SEQ ID NO: 4893 - DNA, 226 bp, Zea mays
  misc_feature: Incyte ID No: 700349225H1
  unsure 158-159: a, t, c, g, or other
ggtgggttctcctcctcggcagcctccagctcccggcggccggcggccacgttcgtcacgcgcatgcgcgggttcgacgggccacttccgttctacctcgaaaccgggtacgtggaggtggacgagcagcaaggtgtgcagctcttctactacttcgnngctcggagcgcgacccctacgaggacccgctgctgctgtggctgtccggcggcccaggctgctccgg

SEQ ID NO: 4894 - DNA, 146 bp, Zea mays
  misc_feature: Incyte ID No: 700349226H1
  unsure 11-12, 15, 21, 25, 32, 35, 37, 40, 46, 63, 66, 76, 79-80, 90, 119: a, t, c, g, or other
cttgcctggannctncgccanatcncaccggnccntncantgtggngtccagcagcatccggnttnatgggggganttnnaccctgcagnaggctcctgctcctgcctctcctgctggntgtaagtggtctccgtcctgtctaggc

SEQ ID NO: 4895 - DNA, 283 bp, Zea mays
  misc_feature: Incyte ID No: 700349227H1
  unsure 52, 261, 268, 280: a, t, c, g, or other
gcgaaagcaaaacgccaaacaggctcctctgaaactcccagagccggtagangcacgccacttccgcagtgtcagtacactgcccccccatcacgccgcccgccctttctcggccgttgccgcgagctcgcttcgacccaccgccgatggcgacggcgatgggcgcgatggccgccacctgcatggcctcgatcccggccgccgctacgttccccggtgatctcggcgtcggacgacgcgagcggttgtaccagggtggcngccggtnggagacggtgcntgc

SEQ ID NO: 4896 - DNA, 283 bp, Zea mays
  misc_feature: Incyte ID No: 700349228H1
  unsure 122, 140: a, t, c, g, or other
cgaacggcgcactcaactgctcatagaaccaaaacccctctccgtcaccgcggtggcaacctgccgtcatcgccatcgccgcgtgcgttctcgaacgttcttgtggcctagaaatacacgtntcccaggccggcgacgcnacgccgacgcggtcacgccttttttttcagccggctggttcacgtgttcgacgacggcgagcgtctgtctaggagcaagatggatgggaacaggatagctcggttttcggtcacctggaggggcagccaacttgatgtggatg

SEQ ID NO: 4897 - DNA, 281 bp, Zea mays
  misc_feature: Incyte ID No: 700349229H1
  unsure 275: a, t, c, g, or other
gtgaaagaggcaattcgtttcattactggtttgctcaggagctctggtaacaaagacaaagatgaggacaaagttgagccaatggagaaattgctgagccactgcaaggagatcgcggaccaggtcaatgatcttggggcttctgtatacccaccacaagactcgtctgagatggagctcgctataaaaagactgtacaatggcatcaacgggatgcgcaaggaaatagggaacctcggtggcgcacctgagagcacctttgccgccctgaaggntcgaaa

SEQ ID NO: 4898 - DNA, 281 bp, Zea mays
  misc_feature: Incyte ID No: 700349230H1
  unsure 61, 179-180, 240: a, t, c, g, or other
aaaaagaataagaagaaaggaatccctcctacgcggaaggaagagattcgtcgcctcagcngcctctctgctcagatctgcggcggagcttcgccggcggcctgcgccccgcggcgccgccgattccaagatgccttcgtgcgtgcagggatgctgctgctgctcgtccctgcgccttnnacccccgcgacgacgcgctctcgtccccctccgcctgcgcgcaccgcctgaagccttggncttggcgtgcccaatcccccactcgtcctcctaacgttgtc

SEQ ID NO: 4899 - DNA, 287 bp, Zea mays
  misc_feature: Incyte ID No: 700349232H1
  unsure 4, 6, 12, 17, 21, 25, 48, 52, 54, 59, 65, 67-69, 73, 86, 90, 102, 109, 121,: a, t, c, g, or other
tttntnaacgtngtggnaccntggnttgattggtgaccgttatctttntggngnttatntttctngnnnttgngttttatattcanatgnctccctaaattnaagtgtngtctcgtgattnannntnnnatgggatnaccattttnctcaacttatanttaaatcagttccanccacctcagatagaattgagctactgaagaatngaaagaagataccaaatatcgagatgtcagatctgtccttcagcaaggactggtcttctacatctggctcaactgantcaa

SEQ ID NO: 4900 - DNA, 285 bp, Zea mays
  misc_feature: Incyte ID No: 700349233H1
  unsure 67, 152-153: a, t, c, g, or other
gcacttcaagaaataacaggacttgttgatggacagctttaccgattttgacaaacagattgggatncctgctggtcctgaatgcaaggcagcacttcaagaaataacaggacttgttgatggacagcttcagtctggccgtaactcagttnnggagctgtttggagcgacaaagttagaaaatgatggtgacttcctgtacttactggcagatgctgctgctattgcgttccaatatggtaatcctgatgtctgtgctccccgctagctgaagcaaagaagatg

SEQ ID NO: 4901 - DNA, 281 bp, Zea mays
  misc_feature: Incyte ID No: 700349234H1
  unsure 3, 7, 40, 45, 47, 50-51, 54, 104-105: a, t, c, g, or other
cgnatcnggagcggccaaaatgaagtttaatccctttgtnacttncnacnnatnctaccctcgcaaaaggcatttcaatgcaccttcccacattcgaaggaagnntatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaagggtgcagcggga

SEQ ID NO: 4902 - DNA, 279 bp, Zea mays
  misc_feature: Incyte ID No: 700349236H1
  unsure 74-92, 250: a, t, c, g, or other
caaggagcacgatgctgagatggcttatgtggatgaagtgatcaatggcatctgtaacgctactgacagcatgnnnnnnnnnnnnnnnnnnnatgcttccgcgaaaggcggacgaggctccaagcagagcggcggcggagtggagggtgagtcgagcaatgccacagaaaggcgaagagatgaagcaactgagaatgccctcgccgtgaaagggaatacccctgggaacatggcgatgacaccggggcanatagcgcacgccaaaataggcagaacagg

SEQ ID NO: 4903 - DNA, 279 bp, Zea mays
  misc_feature: Incyte ID No: 700349237H1
agcttcctccccgctagctcactagccaggcccgggcgcctcaccgccacggtgaccgccgccttctttgacgcctgcggcctgcctaaccccgaagtctctcagtgcgtgtttggccgaaatccacggggagggcttgtcctcgcctttgctgagctgctccggagcggagccgtgcctacttgagttcaggtttgtttcgccatccgaggccaagattcggagcgtcgccgaaggaggcgatgaagggcaaaggcgggccggtggacaggaggtctc

SEQ ID NO: 4904 - DNA, 246 bp, Zea mays
  misc_feature: Incyte ID No: 700349238H1
  unsure 51, 111, 129, 190: a, t, c, g, or other
aaaagaatgaaaagataaggggaaaatcctcaagtgctcgttacataaacnctaacctcgttggattcgcagcaaaagcccaccaattggaagccctccgatgttccagcnccatgctggagctgagcngtgctcggtttgacgaaattttgcatcccttctgtgcttggaccacccgattgaggctgtntctccgagggggcgtgccagcggtttcgcggcccaggtcctcacctgtactatccg

SEQ ID NO: 4905 - DNA, 279 bp, Zea mays
  misc_feature: Incyte ID No: 700349240H1
  unsure 108: a, t, c, g, or other
atcggcacgggcggtaggataaagtagcatagcataccacaaaaggtgctgcttgacagatggcaagcttcccacacctcacgcagatggagcatggcctagccagtngtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagtc

SEQ ID NO: 4906 - DNA, 275 bp, Zea mays
  misc_feature: Incyte ID No: 700349242H1
ttgctgcccgtgatgggtttcatgcaagcggagataacatctttctaacagatggagcaagcccagcagtgcacatgatgatgcagttgttaataagttctgagagcgatggcattctctgccctattccacagtacccactgtactctgcatcgattgctcttcacggtggttcccttgttcctatttccttaatgaagagacagggtggggactcgatgttgatgagctgaagaaacaactggaggaggctcgatctaagggcatcactgtca

SEQ ID NO: 4907 - DNA, 279 bp, Zea mays
  misc_feature: Incyte ID No: 700349243H1
  unsure 126: a, t, c, g, or other
gattgaggcagttcgtgaacaagccgtcacacccactcgctgctgaaccaggagttccatccatcgccgctcactcccacgatcagcgtcgtcgcttatccgcaaatatctctcttcctctttgcngtcggcaccatgggttccgacttcaaatcgatccccttgatcgatatcggcccgcttgtcgaaaagattgatgatccaagcatggccaacgataaggatttactgcaggttgtccggttactggatgatgctgcaaggaggccggattcttct

SEQ ID NO: 4908 - DNA, 214 bp, Zea mays
  misc_feature: Incyte ID No: 700349245H1
  unsure 22, 65, 83, 124, 126, 130, 137, 142, 149, 163, 167-168, 173-174: a, t, c, g, or other
ttgagagcgtggtggtggtccntaacgtggcgaacgggcacaacgtggggacgctggcgcggagngaccggcgttcggcgtcncggaggtggtcgtcgtcggccgccgcgatgtcagcgccttngnagcnatggcgncactngaacttngttccgtcattctntctnncgcgnnggccgagcctactcaagatgcagccagatgtgaatttcgg

SEQ ID NO: 4909 - DNA, 263 bp, Zea mays
  misc_feature: Incyte ID No: 700349246H1
  unsure 171, 202, 204-205, 213, 216, 218, 226, 230-231, 233, 237, 243, 245, 252,: a, t, c, g, or other
tgctttagagagtattaagatctacactgcgattagtgatggaacaatcaatctagttgacaagttcttcgagatgcaaagaaatgatgctgttagggcacttgatgtatacaaaagagcaactaaccaggctgaacgacttcagagtttatgaagtgtggaaaactttcncctttggggtggtgagaattcccgaaatccngnnagcttcangcntntcctgatnaccnngngaantattanantgcccanaggtnaaaagg

SEQ ID NO: 4910 - DNA, 284 bp, Zea mays
  misc_feature: Incyte ID No: 700349247H1
  unsure 7: a, t, c, g, or other
ggcgaanagcgcgagtgagcggcacacttctgagcgaggacgacagcaagatgaagaagcagatatcggacctgaaatccaaggagctgagcggccacgacatctttgctcctccggaagacccacggccacgcaactcagagaacggctcgacctcgcagaccccgggcaaaaatgcacacgtaagcaacttcaagttcggcgaggccgacgaggacggcatggtgaagaccgcgaagaagatccccacaaagaaattcaccgacctcgcgggcaatatcttc

SEQ ID NO: 4911 - DNA, 289 bp, Zea mays
  misc_feature: Incyte ID No: 700349248H1
  unsure 148, 153, 156-157, 171, 190, 202, 206, 210, 217, 222, 238, 240-241, 243,: a, t, c, g, or other
tgttcttcgaggagcacgaggactacaagtacaccgggctcgcgtggctgttcctgggcgtcccgaccagcgacaccctgctgtacaaggaggagctggagaagatgaaggagatggcgccggacaaatttcgggttggactttcgcngtganccnnaaagcagaccaacncgggcccgggagaaaattntacttcaagacncgcntggnggattanaaggngaacttttgggacttntnnanaanggcaanacttaggttaanttncgggntcaaggnatgaggaang

SEQ ID NO: 4912 - DNA, 293 bp, Zea mays
  misc_feature: Incyte ID No: 700349253H1
  unsure 162, 226, 239, 246, 251, 255, 258, 262, 280, 289, 291: a, t, c, g, or other
gcaaagggaggctcggtggcctctcctacttcgccggcgccgagaagaaggacgaccgcgtgctcgtgccggatttggggtcgctcaccagcatccatgaacagggcgcgtgagtcttctactacctcaagggtgggcaggtggactacggcgaggagcacngcaaggtttgcggccacaacaggtttgggagaatatatcatacagggcatatcctgtgtgggangagcacaacccantcatttntgggnaacnttnttgnccccaatttaaaggggcncaaacaaantntc

SEQ ID NO: 4913 - DNA, 291 bp, Zea mays
  misc_feature: Incyte ID No: 700349254H1
  unsure 85, 122, 160, 208, 217, 236, 242, 244-245, 247, 251-252, 255, 261-262, 265,: a, t, c, g, or other
gtttgcctcttctccctcttgccggtcccgaataaagagcagcagcgcaagaggtacggtagagcgagaagaaggcaatggcggncgagagcttccttttcacctcggagtccgtgaacgangggcaccccgacaagctgtgcgaccaggtttacaaaanccgtgcttgacgcatgcctcgcgcagaccccgacagcaaggtggcttncgagacttncaccaagaccacatggtangttttngnngntggnncgncaaagnnaangngtttnanaaaaatntnnnnanccc

SEQ ID NO: 4914 - DNA, 293 bp, Zea mays
  misc_feature: Incyte ID No: 700349257H1
  unsure 4, 42, 159, 167, 195, 199, 206, 208, 234, 239, 242-243, 252-254, 257, 259,: a, t, c, g, or other
cganttgcttgacgaagctttattgagacctggacgattggnagttcacatcgagataaacctgcctgatgaaaatggtcgtttccaaattcttcagattcatacaaataagatgaaagagaattctttcctatctccagatattaatcttcttgagcnagccgcanggacaaagaactacagtggagcagagtngganggtgttnanaaaagtgctgtctcgtatgctttgancgggnaanncccggggannnccncnaaaaccttnggggggggaaanctnnangttntng

SEQ ID NO: 4915 - DNA, 98 bp, Zea mays
  misc_feature: Incyte ID No: 700349258H1
  unsure 2, 19, 93: a, t, c, g, or other
gncgcctccgacatcctantttcgtcctcacgagtgaccgataatccgccggcgctaagatgttggtttatcaagatctcctatctggggagngagct

SEQ ID NO: 4916 - DNA, 276 bp, Zea mays
  misc_feature: Incyte ID No: 700349259H1
  unsure 2, 39-40, 150, 153-154, 162, 173, 179, 188, 199, 209, 212-214, 218, 237,: a, t, c, g, or other
cnagccttcatcaaccctcaggctggatttgctttccannaacctctgatgcctggtatgaggcctggtggtccaatgccgaactttatgatgctatggttcagaaggacaacaaaccacagggcttgccggaaaacttctggggaaaanganncacccccntccaagggggnggcaanaaaagggtntcccaaaaggngggcggggcnatnnnatcngatggggggggaatcctantncgggantnaaagntgggggnnaancccnctcnaaaaa

SEQ ID NO: 4917 - DNA, 99 bp, Zea mays
  misc_feature: Incyte ID No: 700349261H1
  unsure 8, 27, 32, 35, 41, 49, 58, 62, 96-97: a, t, c, g, or other
gttgccanagaattccctcccctagcngacgncgncggcgnttcgtctncctgaagangtgncgggaaacgaggaaatgggcgagtactaggtagnnga

SEQ ID NO: 4918 - DNA, 283 bp, Zea mays
  misc_feature: Incyte ID No: 700349262H1
  unsure 167, 217, 237, 240, 251, 253, 255-258, 261, 264, 274, 280: a, t, c, g, or other
caagggcgtccaaagcccctgtgctcggcgtccttcttccacctccggccgacctccaccttcctgctccatgggtgcccagcagcagcgcccctcccctgctccacagcagcagcagctcgaccctcctctcctcgctggcgcaaacctctcccatggcgcgctgnagcagacgcctggagcatccccgcaatggctcgcgacccggcttcctccntgcttggtgctgtgagagtnccngtggtgttaanantnnnnaanaantggaaaagcnagtttnttt

SEQ ID NO: 4919 - DNA, 102 bp, Zea mays
  misc_feature: Incyte ID No: 700349265H1
  unsure 9, 14, 19, 25, 50, 75, 82, 84, 89, 96, 101: a, t, c, g, or other
gtggtaagnagcantcgcngagagnccctagcgccgccgcacccgcaggnaatgggtatcgaccttcgttcgccnctgggangnataanatagacncaagng

SEQ ID NO: 4920 - DNA, 250 bp, Zea mays
  misc_feature: Incyte ID No: 700349266H1
  unsure 9, 11, 13-14, 25, 34, 53, 90, 104, 107, 117, 120, 124, 131, 147, 159, 167,: a, t, c, g, or other
cggaccggnangnnaggaagggttnaactatgancgccgtggcggtttcgtcntcgctgaacccggacgcgccgctcttcatcccggcgncgctgctgcaggtngangacttctcgncgnagtngtggganctcatcaccaccactncctggttccgcnaccactgntcccgcgagngcgcccacctngnngaaatggccgannagntcgacgcgnangggnttctcccnaaggaaaagnncttttttta

SEQ ID NO: 4921 - DNA, 262 bp, Zea mays
  misc_feature: Incyte ID No: 700349268H1
  unsure 37, 55, 93, 230, 250: a, t, c, g, or other
ttcaaaaaactccaacagagagttccaaaatcactanagaaggtgggagcggtgngggcaagttaaagtggttgtgaaaatagaaagcgaggnagacatgctagttttacaagggagagcaaagtcttaaatctgccaactcacataaccatagacgctggaagaacacagattgctccaagtgagttttcaaagttatggattgtaacttcctttcttatctggtttcngttgattgaaatttccttcnctaaacatagga

SEQ ID NO: 4922 - DNA, 123 bp, Zea mays
  misc_feature: Incyte ID No: 700349271H1
  unsure 14, 25, 29-30, 32: a, t, c, g, or other
caaaggtgaatgangaatggctggnaggnncngtgcaaagggaaggtgggcattttccccaaagtttttgttgaagactgcgcaactacagatttggaaagcactcggaaagaaatctaaggt

SEQ ID NO: 4923 - DNA, 293 bp, Zea mays
  misc_feature: Incyte ID No: 700349272H1
  unsure 197, 212, 216, 241, 245-246, 252-253, 266, 268, 270, 275-277, 283, 288, 292: a, t, c, g, or other
atggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgttgaatcttctggtgtcttcacgacgactgatanagcatcagccacacntaangggtggtgcaaaaaaaggtggtaantctnncacctnnagcggaccccccntngngggannnggaaanaaaanacanc

SEQ ID NO: 4924 - DNA, 279 bp, Zea mays
  misc_feature: Incyte ID No: 700349274H1
  unsure 109, 156, 170, 176, 186, 212-213, 218, 222, 225, 227, 231, 234, 238, 241,: a, t, c, g, or other
tctgaagctcccctttcatatctgagaagaaaaatgtgcaaaaccctacatggcacactgctcctactggccatctttgtctgtttctgaatttccagccatgcaactngcaaaacgtaccaggagaggtatggaaattttgagaaaacttcctangaccaaaaacaacnggaggntgtatatganggctccaatttctttaaaaccggcannggggngacnatntncggnaanaaanagngggcttccccngaaaaatgggggtttgggaaannaaaa

SEQ ID NO: 4925 - DNA, 287 bp, Zea mays
  misc_feature: Incyte ID No: 700349278H1
  unsure 211, 239, 251, 253, 258, 268, 275, 277, 281-282: a, t, c, g, or other
gttagttgttactacgtattcctgctgtatttattctaaaaatccagagaggttagctggatatcttggtgcagggcagctgtatatcctgatgcaatgggacgatctacttgctagatattatgatgttacattttaactgatcgttgtttggtgactctctaatattatgtctagtttattagagcatcaaattacatttccacatctngtttatagtggcacaggtgatacccatngattcccttctnangctgnggatccaatngggtcantncttnngagaa

SEQ ID NO: 4926 - DNA, 296 bp, Zea mays
  misc_feature: Incyte ID No: 700349280H1
  unsure 32, 46, 73, 94, 99, 104, 106, 113, 132, 148, 206, 209, 223, 226-227, 232,: a, t, c, g, or other
ctccaaagtccaaaagcggaacccacgcctgnccgcaacggcgaanccgtcggaaccctagatctctctcgcncgcgctaccgaaaccccaganccgcnatgcncnagcctanagctcgctacccacccggntatggctccggcggtngaggcggagggtaacgtggcggtggaggcggaaatggaggaggtggcggaaaccacanttnctacggccgaaacncgnngcaanacnactaccaccagcagcaancagtcgcagcattctnataggagtnttcgtancagcaacagtg

SEQ ID NO: 4927 - DNA, 285 bp, Zea mays
  misc_feature: Incyte ID No: 700349285H1
  unsure 4, 37, 128, 142, 146, 167, 220, 226, 228, 253, 255, 261, 268, 275-276, 283: a, t, c, g, or other
aggnccgcgccctcgtggtcgcggcacagctctccgngaggtacatcatgggtcggcacctgcctgataaagccatagacctggtggacgaggcctgcgccaatgtgagggtgcagctcgacagccanccggaggagattgntaanctggagaggaagagaatccancttgaggtcgagctccacgcgcttcgagaaggagaaggacaaggccagcaaancccggntnatttaaggtcagaagaattggacgntntagggnaaatttnaaacccnnaaacaanaa

SEQ ID NO: 4928 - DNA, 278 bp, Zea mays
  misc_feature: Incyte ID No: 700349286H1
  unsure 23, 93, 159, 180-181, 204, 207-208, 210, 216, 223-224, 237, 246, 251-252,: a, t, c, g, or other
cagagacaggcgtcttcgtactngcctatctccgcgactcaaagctttccccaattcccccccttctcccatttctcaccaccgccgccgctnccccccgttcaacaacaccatgagggagtggcatctcgatcccacatcggccaggctggtattcangtcggaaacgcgtgctggganngtaatgcttcgaacatggatttnagnnanggccanttgcccnntgaaaaaaccatngggggcgtnaaagnnttnaanncttttnagaaaaggggggg

SEQ ID NO: 4929 - DNA, 222 bp, Zea mays
  misc_feature: Incyte ID No: 700349287H1
  unsure 129, 139, 162, 166, 175, 182, 194, 199, 201, 218-219: a, t, c, g, or other
aagaggtagcaggcatgacaggtatgatgatggagcaggtagaggcggcaggcatgacaggtacgatgatggagcgggtagaagccgcagttatgagagtatgatgatggaggaaggcgtaggcatggntaaccccccnaaagcttagaaagaaccccgtcnaggnaaaccaccnaaggagngaagggccaaantttancntgaacccttagggggannaaa

SEQ ID NO: 4930 - DNA, 281 bp, Zea mays
  misc_feature: Incyte ID No: 700349289H1
  unsure 148, 179, 183-185, 190, 211, 221, 229, 235, 242, 255, 259, 272: a, t, c, g, or other
acttgcattccagtatctcgaagatctcaaaaatgaatttgagaaagtcaatggcagccaaattgaaactgctgcaaggccatatgcatttattaaatttgatgcattcatacagaagaccaagaaactgtatttggataccagaacncagaggaaccttgctaagctgatgatgagcnccannngtgcnccagatctgactcgcaatgtncaagaattcngggtgttnggaaanaaccccnccgggtagggaancccnaagggtttccccngggaaaaaa

SEQ ID NO: 4931 - DNA, 275 bp, Zea mays
  misc_feature: Incyte ID No: 700349292H1
  unsure 9, 50, 107, 150, 159, 176-177, 224, 234, 237, 244, 251, 255, 263, 269-271,: a, t, c, g, or other
cagggagcngcggctagggtttcgcggtgctgtggcggccgacgcccgtncctctactatccgtggcgaccatcgtcggctatccgcggactgtggcgatcggcctntgctcctaatccgcggttgccgaggaaagtaactatgttgttnatgctgganatccaaataggggtgannactttggcccgtaaaaagggacaatttaacatttcccgaatgaaaantatccccccnctnaatgggnaaaaaantttnaatttttnaccccnnngngg

SEQ ID NO: 4932 - DNA, 230 bp, Zea mays
  misc_feature: Incyte ID No: 700349293H1
  unsure 7, 10, 13, 59, 62, 64, 73, 92, 101-102, 124, 128, 133, 142, 158, 160-161,: a, t, c, g, or other
attgganatnggnagcacaaccgcacctcatcagatataagtgatccttccacacctanganancttcaagangccaagaacatttccatanacaacgatnngattgtcttcacattgtttganctanagacnatcacaaanagcttccgtgccgatnannttctcggcgaangncgattngggcaccgtttacacgggctanatacnnaaaatttngggtgnnnaaaaa

SEQ ID NO: 4933 - DNA, 287 bp, Zea mays
  misc_feature: Incyte ID No: 700349296H1
gaggacgctaccataggaatgggagcaggaaccaggaggaggagacggtactcgccccaaagtctccgtcaacctatctaatcgttagtacgtcagtcttttagacgggaagagagatcatttgggcacagagacgaaggcttactgcagtgccatcgctagagctgccatgaagtacaagtaggcaaattcgtcaattagtgtgtcccatgttgtttttcttagtcgtccgctgctgtaggctttccggcggcggtcgtttgtgtggttggcatccgtggccatgc

SEQ ID NO: 4934 - DNA, 309 bp, Zea mays
  misc_feature: Incyte ID No: 700349303H1
  unsure 60, 120, 147, 156, 171, 185, 240, 254, 299: a, t, c, g, or other
gtcctctcgcatccgcagcttccccagccagctagggtttgcagatgacgaccgcggcgngccccacctgggcgccggccaagggcggcaacgagtaggggggcacccgcatcttcggcncctcccagaagttctcttcccgcgacntcgccgggnacacctcctcaagcnaagaaaagacggtnaacagacccaagaggagttacagaagaggaatctcagggaggaattgaggaagtnagcgcaaccactantttccaaggataatcctatgccgaagaaagagaccggcggaaaantctagcctct

SEQ ID NO: 4935 - DNA, 301 bp, Zea mays
  misc_feature: Incyte ID No: 700349306H1
  unsure 3, 5, 30, 38, 63, 69, 80, 97, 113, 128, 146, 157, 161, 174, 181, 190, 204,: a, t, c, g, or other
tgnancggcttcttggcggtggtcggcaangtcggcanctttctgctgtgggtgctgttcctngtcttncagaccgccancaggatcgttcggcaanctcttgccagctcagntgagcagcaggatgnccaccatcaggaatcggnggcggcacggngcangtcgccgccagcntccccanatcccgaantttacgagccggcntctgcgtctntggcgcantgtgggacccaccgctcttccgcaccttgcttttgctcccgtgcggatgagagtcttcgtctccanttnnggcggcgtg

SEQ ID NO: 4936 - DNA, 80 bp, Zea mays
  misc_feature: Incyte ID No: 700349307H1
  unsure 45: a, t, c, g, or other
ctttggacagtggccaccctgccacaatggggccgacgaggccangggccctcctacctgcttacaatttggaaaagtgt

SEQ ID NO: 4937 - DNA, 304 bp, Zea mays
  misc_feature: Incyte ID No: 700349308H1
  unsure 17, 21: a, t, c, g, or other
gcaaaacattgattgcntgtncccagtctgcaacttgtgtcaatgtgaagataattctttaaaaattgtatctgttaactcgggctatgcttcacttgtaaccaatttgatgccttatgggacagtgtcgtgcattctgatatttgaaccaaattacattgtagctattgaagacagcagaaacctgcatatctgggaaatggttgatgggtggagtgagatatctgagcagtatatgattcctagtttgggtaacatgggtcctatactggagcttacaaggatgccaaaaaacacatctctc

SEQ ID NO: 4938 - DNA, 304 bp, Zea mays
  misc_feature: Incyte ID No: 700349309H1
  unsure 100: a, t, c, g, or other
cttcaaatgtgatggaacgatcagtggttgtcctaaatgatattcacatcgacatcatggattacatctcacctgctacgtgtgcagatgttactttccngaacatgtgggcagaatttgaatgggaaaataaggtggctgtgaacaccgtgattcaggatgagaaggaattcttgaatcacattatcaagtcaacgaacatgaaatgtctgacaccaccgtctgcactggatggggaatgtggtttccttgctgctaacctttatgcaaagagtgtgtttggcgaggacgcttggtgaacatc

SEQ ID NO: 4939 - DNA, 305 bp, Zea mays
  misc_feature: Incyte ID No: 700349310H1
  unsure 32, 40, 64-65, 79, 193, 259, 261: a, t, c, g, or other
ttcggaaaggctgctcaccttgttgactccanaaaccaanttggccatttccagaaggtcctgnncggctatcgggaanttctgtatttgctcaattgctgtggggatgtttgttgagatcattgtcatgtatcctatccagcacagggcttaccgccctgggatcgacaacctcctcgtccttctcattggnggcatccccatagaccatgccgaccgtcttatctgtaactatggctattgggtcccatcgtttgtntnaacagggggctatcacaaaaagaatgactgcatcgaggagatgg

SEQ ID NO: 4940 - DNA, 310 bp, Zea mays
  misc_feature: Incyte ID No: 700349312H1
ttctcgccttcttccccaccccaccctaccctggcacccacgcgctcttcagatcagatcggcaaggccaatcccgagcagtggtgcgaaactcgagcgctcgcgccggtgaccataacaaagaggaagccgcggtagcactggtagcggcagcagtaagggggagatgtcgtcggcgttcagcggcgatgagaccgcccctttcttcggcttccttggcgcctccgctgcgctcgtcttctcatgcatgggggcggcgtagggacagccaagagtggcgtcggcgtggcgtccagggtgtcatgcgccc

SEQ ID NO: 4941 - DNA, 286 bp, Zea mays
  misc_feature: Incyte ID No: 700349314H1
  unsure 50, 82, 86, 89, 93, 102, 104, 138, 142, 144, 181, 183, 212, 219, 245, 252,: a, t, c, g, or other
ctagtttgatcatggctggatgatgtggaagaagagcatgatcttggaantgatggtggtgatgatgatcccgcgggatgtntttncantggntctagtttnanccatggctgggattaggactcataatcataatancgtnantcctaatcccagccatgatcaaactagaaccaatcananacatcccaagatcatggctgggattaggnctcacgntattatgcttatgcttcgcctctgtntggggtnttggngttcgtttgtcaantttnagancccagac

SEQ ID NO: 4942 - DNA, 301 bp, Zea mays
  misc_feature: Incyte ID No: 700349315H1
  unsure 277: a, t, c, g, or other
catggatgaaaaatcagtgctcaacctgtatttcctggacagcggtgactattccactgtgccgtcaatcaatggttatggttggatcaaggcttcacagcaagttctggttccaacaaacatcttcaagtctacaggcaaagtatatgaataagaacccgaaacagaaggaaccagcacctggccttgtatttttccacattccactaccagagttcagcagttttacggctccatttcacaggagtaaagcaggagggtatcagctcagcatcantaactctgggttcttgcctccagg

SEQ ID NO: 4943 - DNA, 303 bp, Zea mays
  misc_feature: Incyte ID No: 700349319H1
  unsure 12, 21, 39, 44, 65, 84, 86, 90, 107-108, 112, 122, 130, 133, 137, 145, 148,: a, t, c, g, or other
aaagaacgcggntggaacganccgccacaattctcctangggcngcagactcagactggtggaancaaacgcactccccgtacnangaangttgcggccccacaggnngganggctagagcnccagaaantcnggancaacctcnagnggatcatccacnnccttcaagtaaggnttcnaggcctccacccanggggagctntnctgcttcnggtgtggaccccccaanttctcnagncantgagnctgagactcgaatagangacgtgctaagacatctggaacaggcacaggaggatgccg

SEQ ID NO: 4944 - DNA, 108 bp, Zea mays
  misc_feature: Incyte ID No: 700349320H1
  unsure 81, 90: a, t, c, g, or other
gattaacctagtaaaaaacttccatgttccaggcctatgctgtatgatatgtgacagcatgatgttctggtgataaaaaanaaaaaaaangggcggccgccgattatt

SEQ ID NO: 4945 - DNA, 297 bp, Zea mays
  misc_feature: Incyte ID No: 700349322H1
  unsure 44, 156: a, t, c, g, or other
ctctcctcccaccacacccggtcgtcgttgtcgcggcgtgagcnagcgagaggggaaaacccaaaaccctagcacccccgccccgtcgccgacggccgccggagtagagagatggcggtggacgaggtgaactcggtctacgtcggcggccttccntacgaggccaacgaggagatgcttcgcgacgccttcgggtactacggcaccatcgtctccgtcaaggtgattaatgatcatgctgtcaaaggcaatgttatggttttgttatttcatcaccccagagctgctgagcaagca

SEQ ID NO: 4946 - DNA, 298 bp, Zea mays
  misc_feature: Incyte ID No: 700349323H1
gccggcggcatcttcgagatgaccgtattcccgcgcaagtacgccatcgagatctcctccaaagtctacggcagctggaactttcaccgagcaggccctccccgacgactcatcaagcgaggcatggccgttccagatccgtcgagcccctacaaggtgcggctgctgatcgaggactacccgtacgcctcggacgggctggccgtgtggcagccatcgagcagtgggtgacggagtacctggccatctactaccccaacgacggcgtgctgcaggccgacgtggagctgcaggcgtg

SEQ ID NO: 4947 - DNA, 222 bp, Zea mays
  misc_feature: Incyte ID No: 700349324H1
  unsure 7, 48, 78, 82, 84, 95, 99, 101, 123, 152, 160, 162, 166, 168, 174, 180,: a, t, c, g, or other
cagtganaaacttcaacccaggaatggcgatgtcttggacaagagggntagagcatggtgttgttccgaggcatgacnctcntnaggtagagagnggangncttgcaattgcaagcaaggcgnagaacggtggaaagggtgatacttccatnactcctgntntcancngccaantcaagngtnnaacanngatcggggctgncatctcanggagngttctga

SEQ ID NO: 4948 - DNA, 295 bp, Zea mays
  misc_feature: Incyte ID No: 700349326H1
  unsure 53, 63, 68, 83, 195, 203, 277-278: a, t, c, g, or other
cgcgaggatatgacttttgaagaagctgttaagctggttgagaagtgcttgtngatagctganctgtnacggtacagcaaganccagcaagcacttctcaaccagcttaacagcttcttcaaaagtgcttgctggtcttgctgtaccgtgacaggtcatctatcaacaaattccagattgccaagatcacaactntaggatcntcatctacccaccatattccttgaagacctactggggttctctcatttgaaaaccagcccaggcgctgtgggannaggtagataatgcgccg

SEQ ID NO: 4949 - DNA, 293 bp, Zea mays
  misc_feature: Incyte ID No: 700349329H1
  unsure 31, 91, 156, 265-266, 270: a, t, c, g, or other
atttcgattcgatttgccggcggtgcccgcngcggagaggatggcgagctccttctccttcccgctgatgaatccggcggacattgcggangcgctgcacagctactgcatcgcgcccagccccggcctccgcgccgagcacatcgtcaccccgcngcccggcctcgtcgccgaggtcctcgccctcttcctcgccaattcgtcggcgagagagcccgacgagcagctagagtttcaggcgctgcaggcgatcgacaacccggannacanatgcgcgccatacgctctcgcgc

SEQ ID NO: 4950 - DNA, 296 bp, Zea mays
  misc_feature: Incyte ID No: 700349330H1
  unsure 102, 114, 274-275: a, t, c, g, or other
gaggagttggtgagcgaactcgggatcagtgggtgaccgcagagttcttgcttcttcctcttggaggaggagggctgcagctgcagaggccggagagagcangaggaggcgganacatgggtagcttcgctaagctggcgaggagggcggtggagacggacgctccggtgcatggtgaagatacaagaactgctccgaggggccaaggatgtgatgtcgcttgcgcagggagttgtttactggcaacctcccgagtcagctatggataagatcnnaaagatcatcagggaaccata

SEQ ID NO: 4951 - DNA, 297 bp, Zea mays
  misc_feature: Incyte ID No: 700349331H1
  unsure 41, 74, 147: a, t, c, g, or other
gacggaaatcaacctgcgccgctgccttctccgttctcgcngtcgcctccgcctccgctgccgccgcgcaggtncagggtcatgtcgatcttcgagtacaacgggagcgccgtggtggcgatggtggggaagaactgcttcgcgatngccagcgaccgccgcctcggcgtgcagctgcagacgatcgccaccgacttccgacgggtgttcaaggtccacgacaagctctacatcgggctctcggggctcgccaccgacgcccagacgtgtatcagggctggtgttcaggcacaattg

SEQ ID NO: 4952 - DNA, 299 bp, Zea mays
  misc_feature: Incyte ID No: 700349332H1
  unsure 29, 149, 162: a, t, c, g, or other
cacttctcgccttctctaatctctttgcntccctccaccaccagtccaccaccactgctacccaaccctcgcttccccaaatccctagccaagggacacggtggccggcgatggacggcgacggaggaggcgctggtgcgctgcaccancacacgcgctcanccgaggacgtcttccgcgatttccgcgcgcgccgagccggcatcgtcaaggcgctcaccacggatgtggagaagttctatcagcatgcgatccagagaaagagaattgtgcctttaggtttgccaaatgagattggg

SEQ ID NO: 4953 - DNA, 295 bp, Zea mays
  misc_feature: Incyte ID No: 700349333H1
  unsure 80, 101, 165, 189, 201-203, 205-208, 210, 213, 244, 272-273: a, t, c, g, or other
gacccgtggaggtctggcccaggctgtcaacgtccatccatatataggatcgggtggcagctgctgcaaggggcctcgtngatcaactatccatgcctgancgcctccacggattctgttagagccttttctacttcgccttgtgtccgaaatctacacattgtngacccatttattcgtatggcttanattgtcctcatnnnannnncntantgcgccatgaagagttaaaaagggatatttnaaccaaatttatgcgcttaaattaatcnnctaaggaccttacttggccctg

SEQ ID NO: 4954 - DNA, 301 bp, Zea mays
  misc_feature: Incyte ID No: 700349334H1
  unsure 61, 90-123: a, t, c, g, or other
cgattcttgaccatcctgctgttctgccttctccgtccgcgccttcgagaaggccacagancgaaggaattgcagagttttcttggcgcnnnnnnnnnnnnnnnnnnnnnnnnnnnnnnnnnntgtttatccagaagggcatggaggacggcggcgtttgggctctacggcttcaaccatttcacaaaatctggtttcctggagcatgcgaagaaattcagagaggaggatatgcagatccggttggatggaaaaaatgcctagtaactggagcgattctggcatggttttgctacggctg

SEQ ID NO: 4955 - DNA, 295 bp, Zea mays
  misc_feature: Incyte ID No: 700349337H1
  unsure 95: a, t, c, g, or other
tccaatcgtagttgctgtagactgccctttccctccatcagacaaaattggcataaactctgtccaaagggaaaatgaggaaatagtgccaatgnaaggcgatgaagatggcatgggtgccttatgttccccttgaggaccggcttagcaggattgacagtttgaaaacaaaaatattcactctcggatgcacgcagcggaggtctgcactgaagcatctcaaaattgagagagtcaagaagtttgactactgcatgccttactatatgccgctgcaacctcttgaagacgagaa

SEQ ID NO: 4956 - DNA, 288 bp, Zea mays
  misc_feature: Incyte ID No: 700349338H1
  unsure 235, 258: a, t, c, g, or other
gttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgctttggcacggcacacagagctcatgcttcaaccgaaggagttaccaagtatttgangcctgctgttgccggcttcctcngcagaaggaattgactacctgttggagcgt

SEQ ID NO: 4957 - DNA, 296 bp, Zea mays
  misc_feature: Incyte ID No: 700349340H1
  unsure 101, 146: a, t, c, g, or other
gacgcagtcggctgccgcagactggtagtagccggcgcgccgtcaccgtatcctcagatcagaggcgagcagaaaccacaccacttctactgacgcccgancgagcagtgtaacattttccttcagccatgggtaaggagaagacnccacatcaacattgtggtcattggccatgtcgactctggcaagtcgaccaccactggccacctgatctacaagcttggaggtatgacaagcgagtgattgagaggttcgagaaagaggctgccgagatgaacaagcggtcatcaagtatg

SEQ ID NO: 4958 - DNA, 293 bp, Zea mays
  misc_feature: Incyte ID No: 700349343H1
  unsure 44-45: a, t, c, g, or other
ttaggaagaaggtgatgccagctgtcattgtgaggcagcgcaannatggcgccgaaaggatggtgtctacatgtactttgaagacaatgctggagtgattgtgaacccaaagggagagatgaaaggctctgccatcactggacccatcggaaaggagtgtgctgatctgtggcctaggattgccagcgcggcaaatgcgattgtctagtggaatcagttgatcgaaatttacttcaaataacattgtttgtgttgcgattgggaagagatttttagttagacgagctttgatg

SEQ ID NO: 4959 - DNA, 285 bp, Zea mays
  misc_feature: Incyte ID No: 700349345H1
catttgtcaggctggaaatctatctgatttctacgagaattgccggggtttagaacttgcgaggaattttcagtttcccactctgagggagccgccacaaacatttcttgcaactatggaggagtatgtgaaggaggctccacgcatggtcccagttcgagaacccctggaacttcctgagaggctcttcttacatacaaacctgaagatcggaggacatcctgagcctgcttctgttgaagaggaaaatgcaccattgaagagctgttctggtaccactgttat

SEQ ID NO: 4960 - DNA, 290 bp, Zea mays
  misc_feature: Incyte ID No: 700349347H1
ctccccactgaacaggtgactggcgaaataccctttcagatcactgagatatcctcagaatgggcttattgtactgaggacacaaaggtccttgtggttggatgtttccatgagaactacagacatctggctgggaccaatctcttctgtgtcattggtgaccagtgtgttgatgcaaatattgttcaaactggcgtttaccgtttcatgctagaccacatgctcctggacgagtcaatcttattgactttggatgggaaaacaccaatcagtgaggttttgagttttca

SEQ ID NO: 4961 - DNA, 289 bp, Zea mays
  misc_feature: Incyte ID No: 700349348H1
  unsure 10, 16-17, 24, 26-27, 32, 34, 46, 49, 54, 58, 65, 76, 90, 102, 104, 109,: a, t, c, g, or other
gccttgcccnacgacnngacgctncnngttgncnacggccatggcntcnccggncctngccgccngcttcgcaacntcgattttcacctngctctctgtccncngcctncctgtnnttcggtncggcttccgntcnctttctnnncccaacctcctccaatctgttnggagggtgtgcgagatgtgccgaacggcgaagnaagcgaangacgagatggtggcgcggcgttcnccgtgatgggcaagtatttcagcgtgngccgccgctcccagnaggccgttgctccac

SEQ ID NO: 4962 - DNA, 313 bp, Zea mays
  misc_feature: Incyte ID No: 700349349H1
  unsure 6-7, 15-16, 23, 41, 43, 108, 254-255: a, t, c, g, or other
gctccnncattatgnnacctaanctatagatgtcagacttnanggacattttgccatggtattggtattctggagcgcagtatcctagggataaaagccgttcattgntcatagtacgtgatacttcagccagccttgatagaccaaagtctgcaatctttggtaccatttgatcatgtactagtatgttggcaggtttaagatccatgtgaatgatgtcccttaagtctgacatctatagtttaggtgtcatnngctggagctggtgaccgggagaaggaggagccggacatactaatgtacttcgaggtgg

SEQ ID NO: 4963 - DNA, 311 bp, Zea mays
  misc_feature: Incyte ID No: 700349350H1
  unsure 2, 19, 22, 25, 275: a, t, c, g, or other
cngtaaagcgtgatggcancgnggnccggcgagggcccgagccgactacgactacctcatcaaactgctcctcatcggtgacagcggtgttggaaaaagttgtctcctgttacggttttcagatggatcatcaccactagcttcattaccactattggcattgacttcaagataaggactgtcgagttggatggcaaacggattaagttgcagatctgggacactgcaggccaagaagtttccgcacgattactactgcttactacagggagcangggcacttgcttgtgtacgatgtcacagacgatcac

SEQ ID NO: 4964 - DNA, 312 bp, Zea mays
  misc_feature: Incyte ID No: 700349352H1
gagtcggaatccctggtggataacataaaatttgatcatggatatactgctaaaagtcctgcgatcgtgaatgtaagctcattcgtcctcacatgctacatctcttacatacatccagttgtggtttttgagaagtgtggttccttgattcttgctcttgtttgtagctactcgagattttgtcagaattcacccctgagcagcagcatgcgttctgccagtttgtaaccggtgctcctcggcttccacatggtggattggctgcccttagccccaagcttactatagttaggaagcatccttcaagtgctg

SEQ ID NO: 4965 - DNA, 308 bp, Zea mays
  misc_feature: Incyte ID No: 700349353H1
  unsure 22, 25, 30, 227-229, 242, 249, 254, 265: a, t, c, g, or other
tctccccttccatcgagcgcangcnctgcnccgccgccaccactccgcaccgccgccagttccccacttcctccccacacccgaatcggattgaagccagaaggcaaggtgaagagtgggcttgggtaacggttgcaaagagatatccccaacagttgcagtcactcgcatccagtcggctcagctatggaggaggactcatcagcgatggagccgaataggctgtnnnggccgaggcggcngctgggnagctnaagaggctgcncgaggccgggcatctcatacatgtaccggtctatcgccgagcc

SEQ ID NO: 4966 - DNA, 304 bp, Zea mays
  misc_feature: Incyte ID No: 700349354H1
  unsure 2, 29, 227, 234, 236, 293, 299: a, t, c, g, or other
gncctcaaggcctcaaggcatcgccggcnccgcaacttcgctgaggaagcccgcacccctgcccggatccgatggccaacagcaacctcccgcggcggatccatcaaggagactcagcggctgctcagcgagccagcaccggggatcagcgcgtcgccctcggaggagaacatgcgctacttcaacgttatgatccttgggccggcgcatcgccctatgaaggtggnttttaantngaatctttttacctgaggaatatccatggctgccccaaagttaggtttctgacaagnttatcntccca

SEQ ID NO: 4967 - DNA, 313 bp, Zea mays
  misc_feature: Incyte ID No: 700349355H1
  unsure 21, 35, 190, 211, 220, 224, 227, 233, 243, 246, 248, 251, 268, 270: a, t, c, g, or other
ttttaatcctcactctaaganacatggcggtccanccggatgaagagaggcatgttggagacctgggcaatgtggctgctggaaaggtccggtgtggccaatgtgtccattgaagatccgtgtgatctcactctcaggagagcattccatcattggccgtactatggtggtccacgagaaacaagatganttgggcaaaggtggaaatgangaaagtacnaagnctngaaatnctggaaaacncgntnggncttgtggtgtgatgggnangccccataaacatccctatgtggtctgagtctcagactcatct

SEQ ID NO: 4968 - DNA, 293 bp, Zea mays
  misc_feature: Incyte ID No: 700349359H1
  unsure 19, 163, 165, 167, 172, 175, 180, 185-186, 188, 196, 200, 204, 206, 222,: a, t, c, g, or other
ggaaccctctgcaacaaanccgcctccacctgaccacctcccttgagctcttccccttcctcgtgggttgtgcgagccctctaccggcgcgcagtacaggggctgattgggtgatcaaacccgcaagatttgggtttgtgatttaggagcaggaggcggtggnantntggantanagggngaatnntntggaattnaggnattngncaaaaatttccggaancngaaaaatgnnantccggggnttttaaagggacgaaccatgnggtnctanatnggaaangncagngnttt

SEQ ID NO: 4969 - DNA, 298 bp, Zea mays
  misc_feature: Incyte ID No: 700349360H1
  unsure 22, 202, 214-216, 219, 225, 241, 292, 296: a, t, c, g, or other
ctccaacaaaatcttctaaggnagagaatgatgagatatcaaaactgccacctgctcagaggaagaagttgaggcaaaagcagaagaaagcagaagcgcgtgctaaaagggaggctgaagagaaacaagaggatgaaacagcttccatctaacagttcaaaatctggcagaaacactgccagacccatttgatctggatccnctggtgaaaatnnnatnccagantgccgacccgttgcanaagccacaaaattttgaagctctgcggatcactcgtcggcccctcggtttntttnct

SEQ ID NO: 4970 - DNA, 300 bp, Zea mays
  misc_feature: Incyte ID No: 700349361H1
  unsure 145, 153, 166-167, 169, 172, 174, 176-177, 181, 184, 186-187, 192, 196,: a, t, c, g, or other
gcgccgtgacgacgttaaggcaatcgtgctcactggtgctggaggcaagttctgtggaggatttgatatcaacgttttcacaaaggttcatcagactggggatgtatcacttatgccggaccgtatccgtcgagcttgtgtcaancatgatgnaagggggaaaaanncnttntntnnccgntananntgttncatngnggggnggcccaaaattnncnaatgggtnntcangcncgaaaancnacnccagaannncagatgggnngaccccacctnaccctnggagaaaccngggnaggg

SEQ ID NO: 4971 - DNA, 296 bp, Zea mays
  misc_feature: Incyte ID No: 700349362H1
  unsure 69, 112, 119, 171, 173-174, 179, 182, 201-202, 211, 221-222, 226, 232-234,: a, t, c, g, or other
caatctcacatggctcggcgtctccacggccaatccgacctcaacgacggcgcgcgcctaccgtttctnccacctaccaacttccagctccagctcttcctcccggttatcncctcgcngccccctgccgacgacgcctccctctgtcggatccaccgctgaccgcgcgcngnnacgcntgngcatgatcagggttggttnntggttcttngattcaaggnncgcnagaggnnncangggnaanataaagaacaagnggnngaagtggtggtgnngannaaagctgaggtggggnc

SEQ ID NO: 4972 - DNA, 301 bp, Zea mays
  misc_feature: Incyte ID No: 700349363H1
  unsure 2, 50-51, 53, 123-124, 163, 166, 173-174, 199, 204: a, t, c, g, or other
cnaaacaaatgcagacctggcagaggcgtccaaagaatcattagaggcgnnantggcagtctgcaaacacagagatagggaaactgaacgggattgtgcaaactttagagaatgaggtgaggnnagagacagattctcgtgaagaactactgaaacagatagnggntatgaannttgagtcagagagatcactatccgnggtgnccaccaaagagtcttagaggtgcagctccaggtggcgattcagaagttgccaattgcgtgggatggtgatgctctggatgtgatgcggcgaaccaaa

SEQ ID NO: 4973 - DNA, 309 bp, Zea mays
  misc_feature: Incyte ID No: 700349365H1
  unsure 136: a, t, c, g, or other
tcaggttctgaaaagggtttctgaggaacactgggtgatcttcacatgggccatgcgctcaataaaatcctcaaggattttataaatcgctacaagctgcttcagaatcataaagtgtcctttgttcctggttggnattgccacggccttctaatagaactaaaaggtggcttgtgcgaacgaggcgtggcaatcgatgcgcagtggcaaacccaaaaatcttcaaaagcctaggcaaaagtagtaactaaagatacatcaccttgtccatttttctgcttttacttcgactatatgtcatgtgccaca

SEQ ID NO: 4974 - DNA, 308 bp, Zea mays
  misc_feature: Incyte ID No: 700349366H1
  unsure 61-81, 254: a, t, c, g, or other
aactaaaacccgcgatctgaagcgactagtcgaaggcggcggcggcgatggggagcgaccnnnnnnnnnnnnnnnnnnnnnccccggtggcactaatgcccatcgcgaacccctcgcaggaaagaagctctgcaagcggaccctcaagctcgtgcgacgagcctctgaggccaagtgcctcaagcgcggagtcaaagaggtagtcaagagcttcgccgcgggaacaaagggttgtgtgtgattgctggaaatanttctcctattgatgtgttacacacgttccaatactatgtgaggaatctaatgtt

SEQ ID NO: 4975 - DNA, 63 bp, Zea mays
  misc_feature: Incyte ID No: 700349368H1
  unsure 12, 25, 32, 54, 58: a, t, c, g, or other
ggcgcttgggcnacgatcgctaaantgaagcnacagctcgctgcctcgctttancaanaaaag

SEQ ID NO: 4976 - DNA, 301 bp, Zea mays
  misc_feature: Incyte ID No: 700349369H1
agctcccagaggtgacaaagtcactgcgaccatttggtcccaaggaagattcgtctctctcagagttccaagtggagttgattcaacttgcctcgcagcttaacggcgaccatgtactgaacacgtacccagatattggcaggaccatgactgtcggggaagcgaaccgctacgcagaggatgctgtcgccagattcctggaagctggtcggattgctttgagagctggtgcgaatgaatctgcttggtgacgatgaggcccgctctcacaagcaggcctcaatgtcctctggtttatcac

SEQ ID NO: 4977 - DNA, 299 bp, Zea mays
  misc_feature: Incyte ID No: 700349370H1
  unsure 277, 288: a, t, c, g, or other
ggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaagaaaacattgcacctgactgcgttggatggtgctaaggataggctgcacttatttaaagctagctgctagagaaggttcttcgatgctgcagttcatggatgcgacatgtatttcatactgcctctncctttatcacnatgtcaaggat

SEQ ID NO: 4978 - DNA, 297 bp, Zea mays
  misc_feature: Incyte ID No: 700349371H1
  unsure 225, 253, 261, 264, 266-268, 271, 273, 275, 292, 296: a, t, c, g, or other
tagccctgggagcagaaagaaggtcataacagcaaccgctagacaaatagagagtttgatccgtctcagcgaagcattagcccgaatgcggttctctgaagtggtcgaggtgcgggatgttgtggaggcattcaggcttcttgaagtcgccatgcagcagtctgcgacggatcatgcaactggtacgattgatatggatctgatcatgacggggatatccgcaancgaaaggcagaggcgggagaacctcttnccgaaacncgnannnatncngnaaaaatgccacttgagncccnc

SEQ ID NO: 4979 - DNA, 270 bp, Zea mays
  misc_feature: Incyte ID No: 700349374H1
  unsure 12, 18, 38, 53, 67, 69, 71, 80-81, 107, 120, 139, 145, 153, 159, 166, 184,: a, t, c, g, or other
tgaatttggctntgctanctcaatttgcaggtgtgtgnttgcctttataaacngtctgcaaatgganancnatatatttnngagtaagagcaatatttaaacatttntacacacatcggngttggaaaattgccatttnaggccncaattttnaaaaanttttggncgggcattccacagagtntttgcccancggtagccannanattaaanccggtnggancccttgggntnncanaactcnctagaaggggtcnctacggnaacact

SEQ ID NO: 4980 - DNA, 296 bp, Zea mays
  misc_feature: Incyte ID No: 700349375H1
  unsure 177, 181-182, 187, 192, 208, 224, 226, 229, 262, 280, 285, 293: a, t, c, g, or other
gtgtccattgtggagttgaatcatattcttaatgaagtgaatacccacatccttccttcccacaatgatctcaccccaataactacaatagccggtggaagtgttgccaacacaatccgtgggctctcagctggttttggaatatcaactggaataattggagcttgtggggatganaccnnggganttttntttgaaacaatatganctttagtggtgtagancncanaaggttaagggccaaaaaagggcacacggctcnagtgtgtgtgcttggttnatgcnagcggcancgc

SEQ ID NO: 4981 - DNA, 250 bp, Zea mays
  misc_feature: Incyte ID No: 700349376H1
  unsure 12, 16-17, 20, 24, 26, 33, 169, 172, 183, 187, 193, 199-200, 204, 209-210,: a, t, c, g, or other
gggatgccatancatnngcntcantnccatctnctcctatttgttctcgcatccagttgtcccttgctgcgagaacaaatagagaagatgggattgatgctgctgttatggctaggctgagaattttgaagtctcgacctgataatgaaacctcaatgggcgatgccancanggagcagcagncgcngggggnaacaannaaanggggnngcnntgggatgngnccantggagncatggcnaancnnngg

SEQ ID NO: 4982 - DNA, 296 bp, Zea mays
  misc_feature: Incyte ID No: 700349377H1
  unsure 2, 58, 107, 138, 141, 144, 147, 149, 155, 157, 168, 173, 188-189, 205-206,: a, t, c, g, or other
cngagccgcggaccggatcagaactaggtctcgaggcgatggcaagcggaggcgaggncgcagggagcggcgaatcccctcccgccgcctcagtggaggcggcagcngttcgaggcgacgctgcacatccggtgcgcnaanggntcnantttcangntgcagacgaanttggnccccacggtggcctnntaaagggtttttttanngntaantngggggtcnaaannncnanatgcgcnttannnaaaagggccnnntcctnaaggacgancaaaccctagacanctatggcttga

SEQ ID NO: 4983 - DNA, 287 bp, Zea mays
  misc_feature: Incyte ID No: 700349378H1
  unsure 145, 162, 176, 190, 198, 204, 207, 209, 217-219, 224-225, 227-228, 230,: a, t, c, g, or other
gtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggnacatcaacccggccgtnaccttcggcttgtncctggcgaggaagntttccttngtccgnccntnttaaaaannnggaanntnngngnccnntngggggnngcccctntaaaagnttccaaaaccntttatgggngngggggg

SEQ ID NO: 4984 - DNA, 299 bp, Zea mays
  misc_feature: Incyte ID No: 700349379H1
  unsure 74, 154, 158, 164, 175, 178, 188, 192: a, t, c, g, or other
gagagatccggagcagccgcagtcccaccgaccccgccgccggtcgccctccatctcctacgccgctgcctctncgtttctacttttcaataatcaagatgagccgtggtggtagtgccggtggtggtcaaagttctctgggttatctctttgnaagnggtgancccccaaaacnagnatggcaccanctgnaagtgttcaacttgttgagaaacaatctgctgcaaaagactgatgcggcaaagcaggttgctgctggggttaccagccaaaccaataataccacagggctgatggtc

SEQ ID NO: 4985 - DNA, 288 bp, Zea mays
  misc_feature: Incyte ID No: 700349380H1
  unsure 153, 176, 190, 194, 199, 203, 213-215, 218, 221-222, 240, 248-249, 262,: a, t, c, g, or other
cttcacttatccgaggttccgtgcagcagtggaaaagagcagattttagcagagcagcgagggtcggagaagcctccccaagcttcgaatcgctatgcagcccgtcaaggtgtacgccgaccggcggtcgcaaccctcccgagctgtcatcancttctgcagggtgaaccagatcnatttcgaggaggtngagntgttnaaantcaggactcnnnacnggnnttgaaaaaaaccacccgngggacganncaaattgaatcantggattgcaaantcaanntggggggg

SEQ ID NO: 4986 - DNA, 301 bp, Zea mays
  misc_feature: Incyte ID No: 700349383H1
  unsure 85, 160-161, 187, 190, 215: a, t, c, g, or other
ccgactacaacattcagaaggagagcaccctccacttggtgttgcgtctcaggggcggcatgcagatatttgtgaagactctganctggcaagactatcacccttgaggtcgagtcttctgataccatcgacaatgtcaaggccaagatccaggacaagnngggcatccctccggacccagcaagcnggntcatttttgccgggaaacaacttcngaggacgggcgcacgctggccgactacaacttcagaaggagagcaccctccacttggtgctgcgttcagggtggctgcagatcttc

SEQ ID NO: 4987 - DNA, 297 bp, Zea mays
  misc_feature: Incyte ID No: 700349384H1
  unsure 230-231, 290, 292, 294: a, t, c, g, or other
aaacaatcagctagcacgggtatatcagtttttcagcgtttaacagaaggactcgcgagcaagctctccaatgatgagtggggaacggtcctgttgtgcttcaaagaatcagcagcacatacatttgttgtgtttgacaaaatagttaaaatgatgaaagtgcattgaaattccagatagaaatgaatcttactctgaagctgagcaatattcagatcatgacatatacnntgatgaagaagaggaagccaatatggaaacggcgtcttatgcatgtcagaatgaaggancntntgg

SEQ ID NO: 4988 - DNA, 295 bp, Zea mays
  misc_feature: Incyte ID No: 700349385H1
  unsure 293: a, t, c, g, or other
ccgcgctgcaatccaacctggcgccgccgaacccttctctcgcccggtgctgccgaagccgaacccttctctcgcccggcctgccgtagtcctccactccgccggatcctctctcagctcgagcggtcttggagatccgtccgtcccgggatcatttggcgcggaggtttggcctgggaaatcggcaaacatacgtgcacttctggtcggcttatcgcgggcaaggggatccttagcagaggctggacgatgtgcttccacgaggccatcaattctagcatcctggggcacanta

SEQ ID NO: 4989 - DNA, 148 bp, Zea mays
  misc_feature: Incyte ID No: 700349386H1
  unsure 2, 8, 10, 16, 50, 57-58, 84: a, t, c, g, or other
cncagaancngcggcngcggatcaaacgcatgcgaaggcgagggtgtganggaaggnncaccagccatggtgcacgtcaacttntatcgcaactatggtaagacgttcaagaaaccaaggcgtccttatgagaaggagcgtcttgatg

SEQ ID NO: 4990 - DNA, 146 bp, Zea mays
  misc_feature: Incyte ID No: 700349387H1
  unsure 5, 33-35, 37, 53, 67, 104: a, t, c, g, or other
agcangtactatgtgactatcattgatgccccnnntnacagagactttatcanaaacatgattatcngggacatctcaggctgactgtgctgtcctgattgttnctgctggtgttggtgaatttgaagctggtatctccaagaatg

SEQ ID NO: 4991 - DNA, 268 bp, Zea mays
  misc_feature: Incyte ID No: 700349389H1
  unsure 152, 161, 166, 169, 178, 184, 187, 194, 199, 201, 206, 210, 213, 216, 219,: a, t, c, g, or other
cttcccggacggttaccggagcacgccggcacggcacaagccatctgcaaaaccgcagagttcagagctgtccacctcgacgcgccaaggctccgatcaagatgccgctgattggccgccatctttgaggcgatccaccaatgcgatgcggncaccaaganggccnggnttttccctnaccaanggngattttncggananagaanagtnttngcnagngannaatnttcnnaagttgntcggcnngnnnaagtgnnngcnagnagna

SEQ ID NO: 4992 - DNA, 146 bp, Zea mays
  misc_feature: Incyte ID No: 700349390H1
  unsure 8, 16, 24, 54, 72, 114: a, t, c, g, or other
ctccaaanatcgtccncacaaatntcacaccattctcctcaggttgatcagcanagtctgttgcaatctcangtcaaaaccgggacaccattgcattcagctaactcaccattngtcccatctccatcccctcctgtggccccata

SEQ ID NO: 4993 - DNA, 288 bp, Zea mays
  misc_feature: Incyte ID No: 700349391H1
  unsure 172, 174, 178, 184, 193, 195, 198, 200, 210, 216, 225, 233, 244, 254, 261: a, t, c, g, or other
gctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactagagctaccnangaangttttnccaatgggncnacnantttgggttcncctccncctgtttantgcaatanggaagaagtancttctttgcncaattgncatcaaggaggttgacctagcattccc

SEQ ID NO: 4994 - DNA, 289 bp, Zea mays
  misc_feature: Incyte ID No: 700349393H1
  unsure 136, 144, 146, 154, 157, 160, 173, 181-182, 185, 191, 193, 199, 219,: a, t, c, g, or other
gcatcagcaagcaagttcctcaattacttcgttaagcaaattgttccagcattcgagaagattcctgaagaaaagaaactggatttgctcaagactattgcttcaagttcaccgtacgcgacagctcaagattcangtccagcngnttccatcngtngtncagttactccaanaaatatannccngggaananggtggncgatctcccccattttgtgnaannngcgngacacttatcatcatttggcccataagactccaaacacaagnangttctnggggttagaat

SEQ ID NO: 4995 - DNA, 139 bp, Zea mays
  misc_feature: Incyte ID No: 700349394H1
  unsure 4, 9, 13, 27, 40, 82, 88-89, 92, 113, 117, 133: a, t, c, g, or other
agantcctntttnatctgttttgttangtttgttaagggnttgtttggttagaaggggattgaagaaagcttcctttttaanccattnngtngattgagtcgcattcccgaanccanacttgaacatcagganctcaaa

SEQ ID NO: 4996 - DNA, 291 bp, Zea mays
  misc_feature: Incyte ID No: 700349396H1
  unsure 75, 78, 80: a, t, c, g, or other
gccgctgagatccggtcgcgcctcgccgatgccgtgagagggatattctcggagttcgagagcgtcgtgctccgngancngtcccaagaccgcggtgcctggcggtaccgtccacccgctcactcgctagcgctcgtcttgctgccgagggcaatgagctcgcgccgtccttagctgacctcgagctccccgagcttgagaaccagttaccccttgcctctcacattgtctggatcatgttattcttgaacacaacctggagggggaaatgaattgacgcggaaagcttgc

SEQ ID NO: 4997 - DNA, 326 bp, Zea mays
  misc_feature: Incyte ID No: 700349401H1
  unsure 290, 292, 302, 310, 318-319, 323, 325: a, t, c, g, or other
cgttggtattacttgaggctacttcagacacgcaaggtacttcaatcgccaccggcaacagtggaaatggaattgagaaccgtgtcttggataaacaaattattgactggaagcttaccttacatcaaataggccttgatgttctgcgcactgaccgcaccatggtattttatgagaacaaagataacatttcaaagttgtgggatattcttgctgtctatgcatggatcgacaaagaagttggttattgtcaaggaatgagtgatttatgttcacccatgatagtgctncnccccatgaanccaatgcntttgggtnnttanana

SEQ ID NO: 4998 - DNA, 300 bp, Zea mays
  misc_feature: Incyte ID No: 700349403H1
  unsure 21, 197, 290: a, t, c, g, or other
ccagccccattccccgtcgcnccggtcggaagcaccaccagctaccagggatgtctggcgaggaggaggagaacgccgcggagtcaagatcggcgaagagttcctcaaggccaagtgcctgatgaactgcgaggtggcgatcatcctggagcacaagtacgagcagatccagcagcacgcgtccgtcggagttcggnacccgttcgtcgcaggtgtcgcaggtgttcgagaatcgctgcatacgtgaagcgctttcagccgctacaagaaccccgacgcgtgcgccagtncgcgagacgc

SEQ ID NO: 4999 - DNA, 317 bp, Zea mays
  misc_feature: Incyte ID No: 700349404H1
  unsure 93-94, 155, 182, 293: a, t, c, g, or other
ggagttgattgatcgattgcagccatgagtaagttgcattccgagcttctcaaggattgcatctcccagatagttcaggatgccaagaagaannggaagttcactgagactgttgagcttcagattagtctgaagaattatgatccacaaaaggncaagcgtttcagtggctctgttaagtngcctcacatccctcgtccaaagatgaaggtgtgcatgcttggtgatgcccagcacgttgaggaggctgagaagatgggactgactacaggatgttgaggccctcaagaaangaacaagaacaagaagctgttaag

SEQ ID NO: 5000 - DNA, 308 bp, Zea mays
  misc_feature: Incyte ID No: 700349405H1
  unsure 109, 226: a, t, c, g, or other
gaccaagggagagaggagagagcgatcgagagatgaggagggagcttgcctcccccttagctactgccgccgctgccacggccggtgcctccttctcggctgccgcctncgctccggggctggtgggacgatgtcaacgagtcgccccagtggcaggacggggccttcttctccctcgccgccgcctacgccctcgtctccgccgtcgcactgattcagctacgtncaggatccagcgccgggtgcccgagttcggatggaccacgcagaaatcttccaccttcatgaattccttgtcaatggggtcg

SEQ ID NO: 5001 - DNA, 319 bp, Zea mays
  misc_feature: Incyte ID No: 700349407H1
  unsure 44: a, t, c, g, or other
ctcaatcgcgatgccaccaatgatgaggtcaccgtcgagagtgncgaggctacattgaagtataatgttgctgttaagtgtgcaacaattacgcctgacgagactcgagtaaaagagtttaaactcaagtctatgtggcggagtccaaatggcacaataaggaatattctaaatgggactgtttttcgtgagcccatcttgtgtaaaaacatcccaagaatccttctggttggaagaaacctatttgcataggaaggcagccttggtgaccatatcgagctactgatatgattattatggtccaggaaagctccagatg

SEQ ID NO: 5002 - DNA, 317 bp, Zea mays
  misc_feature: Incyte ID No: 700349410H1
  unsure 2, 21, 51-52, 59, 64, 73, 77, 167, 171, 173, 199, 209, 223, 271, 285, 313: a, t, c, g, or other
gngctcgcgaaggaacgctgntcgcaattccggcgccggcaccatgagtannctgcagngtgantctcctganggangcgattgcctcaattaccaatgattcccgtgagaagcagcgcaaatttgttgaaaccattgagctacaaattggactgaagaactatgancctnanaaggacaagcgctttcagcggttctnttaagctgcntacacatccctcgncctaagatgaaggtttgcagttggtgatgctcagcagttgaggaggcnagagatgggtacanacatatggagtggaaaccctcaagaagngaac

SEQ ID NO: 5003 - DNA, 320 bp, Zea mays
  misc_feature: Incyte ID No: 700349411H1
  unsure 61, 248, 300, 315: a, t, c, g, or other
gtaagttgagcatccatccatccatggcgggaggcaagtccaccggcaatgccgcgcgcanaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccatgcggntcgcaagaagttcctccgccaaggaggtggtaacaaggacgccaagcgcaangcttcgcccaccgcntcttc

SEQ ID NO: 5004 - DNA, 213 bp, Zea mays
  misc_feature: Incyte ID No: 700349412H1
  unsure 53, 170: a, t, c, g, or other
gtagccatttcaacattgtaggatccttttattttcatcctatacaatctganatgttcttacaggatgaaaataaaaggatcctacaatgttgaaatggctacatattacacattgtaggatccttttattttcatcctgtaagaacatctcagattgtataggtacancgattttgtgccgagccgtaaaaagagcaaaccttggctctgg

SEQ ID NO: 5005 - DNA, 321 bp, Zea mays
  misc_feature: Incyte ID No: 700349416H1
  unsure 18, 48, 57, 61, 75, 85, 95, 112, 127, 135, 155, 215, 238, 241, 267, 289,: a, t, c, g, or other
catcttcccacttcagcncccaaacccgaacactcgcaatcgcaagtngcaaatatntgtngccgtctcgccagnagcaccaatngcctccctangactcgaccgccatggngagccaaggcgagcngtcttccncccgatccgaagggaagaangattactcgacgccgatcctggagaggaagaagtcgctgaaccggctggtggtcgacgangccaccaatgatgacaatccgtngtngctctgcacccggacaccatggagangctccagctcttccgcggtganaggtctgctcaagggtaagaagagaaanacac

SEQ ID NO: 5006 - DNA, 312 bp, Zea mays
  misc_feature: Incyte ID No: 700349420H1
  unsure 17, 26, 71-72, 89, 114, 217, 237, 286: a, t, c, g, or other
tgttattatgtatattntaaaaaganaacattatacgaatttggtggtgaagtcacaattacattttttgnnttgtatcagtaaccgangttttggcttgtattttcaaaacanacacatacctattatacctactaacattagttgctacctattagtgtttctctattaaataagttcgatcactaagtttggtcaatcggttgtataaatttcnttattatataacaccagacnatgaaaggagcctatctaggagtgattctccgataggtcaccaaacacncagtcgtagagtgattttactccggg

SEQ ID NO: 5007 - DNA, 309 bp, Zea mays
  misc_feature: Incyte ID No: 700349425H1
  unsure 19, 45: a, t, c, g, or other
tttgatatgctggtaaggnaagatatgtattgagcttttactacnatacacttcaaacttttggactgaagtttttcatatatggattattgctaaagtgctgaaggccgaagccaatctgtgacctgtcaattacttggacactaatgacctgtttggttcgttgcctaacttaccacagtttgccgcacataaggttaggcaagtttgatcaacttaggcacgtgtttgttttgtagtcacattgtggcaagatttgtctcttgctgcgttggtcccatccatcaatgacttataaaagtgtagcag

SEQ ID NO: 5008 - DNA, 303 bp, Zea mays
  misc_feature: Incyte ID No: 700349427H1
  unsure 2, 119-120: a, t, c, g, or other
gnggttttgggcccgtctactatggccgtttggaagatgacactgaggttgctgtcaagatgcgttctgaatcatcgtcacatgggcttgatgaatttttagctgagagcttgacaaanntgcatcacaggaatctagtgtcttgattggttactgctgggaggaagatcatttggcgctggtttatgagtacatgcctcagggcagtcttttgatcatctgagaggtttgtctatggaaagtctatgagtatgattaggcataaccagttacgttgccttttcaattgctttgaaagtccag

SEQ ID NO: 5009 - DNA, 314 bp, Zea mays
  misc_feature: Incyte ID No: 700349430H1
  unsure 85, 308, 312-313: a, t, c, g, or other
tcgacttggtgggatgtgattctccaccacctccgagcttgcaagaggcggactccacctctttcttcctcgcatgcctccttcncctttccaaacacaaagccgcagcaaagaaagtgcaaattataaaggaagatcagaattcaaagcagtcgaaaagctgactagctagaagagtaaagagagagaagtatatttgcagcaggacctccatggtgttcccttcagtgccatctacctagatccactccacctgattggaataaccagcagcagcaaggtcagcagccgagggcgagtgggggagncganna

SEQ ID NO: 5010 - DNA, 310 bp, Zea mays
  misc_feature: Incyte ID No: 700349431H1
  unsure 71, 292: a, t, c, g, or other
tcccaccccgcagcatccccacgccaccacacctcgtcgcgtcgcgtcgtcaccggcgtgaagatggtctnggccaggcctctacaccgagatcggcaagaagaccagggatctgctgtacaaggactaccagactgaccacaagttcaccctcactacctacacctccaatggcgtcgctgtaactgcttctagcacaaagaaagctgacctgatccttggcgagatccatcacagataaagaacaagaacatgaccatagatgtgaaagcaaatcggagtccaaatatcntacgacaatatgttgatg

SEQ ID NO: 5011 - DNA, 305 bp, Zea mays
  misc_feature: Incyte ID No: 700349433H1
  unsure 40, 279: a, t, c, g, or other
cctggatctaccgcgcgtcatcctccttgcctaggcgtangctacgggcggaaccgagctgcggccttaagcatcgacaccgtcctcgacttccccaccagtacctacagtgaaggccgaccagattgaagtgaagcgccaacgccgacctgtagatctcgcctccaccgccgctagtgccctaccatcccctgtccgcgagtctcggcaaccaaatctgagttttgaagctttgaaccccaggcggttatgttgtcgtagaccccatatagagtgtgnaggggaaatattatgatgtatccgcc

SEQ ID NO: 5012 - DNA, 306 bp, Zea mays
  misc_feature: Incyte ID No: 700349435H1
ggcatcacgaggcttttgctgacgttgatcccgcacttccgggaggtggttctgatggccttcgagtgcccacattgtggtgagaggaacaacgagattcagtttgctggacaactccaacccaagggatgctgctacagcttggaggttccgttggggcagagtgagatgctgaatcgtcaggtcgtgaagtctgattcagcgattatcaagattccagagctcgactttgagatccctccagaagctccaacgtggaacatttctactgtatgcttcattcttctgtattgttttgttgggaaa

SEQ ID NO: 5013 - DNA, 300 bp, Zea mays
  misc_feature: Incyte ID No: 700349436H1
  unsure 2, 289: a, t, c, g, or other
anaagtactatgatcttgtcactggcttttacgaatatggatggggcgactcattccatcttgctggcgggtcagctacatatacataccttgctctagttattactatctatcgacgaaacagcatccgttgtatctcagttgagatgtcgagttgctctagatcaaagttttggtaattttacagcttcagtcccatactcccatgcttgtattcagatatccgggtgagacttcccgtgaagccataagcggcaccagcatttttggcatacaatggggctcaganggtagaagttt

SEQ ID NO: 5014 - DNA, 309 bp, Zea mays
  misc_feature: Incyte ID No: 700349437H1
  unsure 157: a, t, c, g, or other
cgacgccgttcatgctgtcctcctctccggcgccgtcacaagagggcgccgccgttccctcctcctgggcggaagtgcgtcctcggcggcgctccggcactaccgctcactggccaagaaagggaagccgcaggggcgcgagtccacggtcctcgcngccatcctcctctctgccccgcaggacccgcacagcctacactgtgctctccatgggcaccggcaccaagtgcctcggtgcctcgatgcttcagcgcacgtggggacctcgttcagacgcgcagctgaggtcatcgctcgccgcgcgctgct

SEQ ID NO: 5015 - DNA, 314 bp, Zea mays
  misc_feature: Incyte ID No: 700349438H1
  unsure 5, 45, 47: a, t, c, g, or other
ttgtntctcctccaccccggcgacgcgaatggagaagggcagtgnangcagcaatcctccgccgccaccgctaccacatggaggacttccaactggaggggaagaagcccgtcaagaacccctttgtgcccatcggcgcactggttactgctggagttctgactgctggtctgatcagtttccgatatgggaactctcagctgggtcagaaactgatgagggcacgtgtagttgctacaaggcgctaacagtccgctactgatgattggtcatgttactactatggcgattcaaatcaagctgtttcaagaaag

SEQ ID NO: 5016 - DNA, 304 bp, Zea mays
  misc_feature: Incyte ID No: 700349439H1
  unsure 16, 29, 46, 127, 144, 178, 277, 287, 300: a, t, c, g, or other
ctcgccgccgttagcncgccccgagcccngacagcctttctccttntagggtttctctctgtttcgtcctcatcgaatcggagtttcgcatggagtcatcgcggtctcggaagcggacgcgccaggngcatgactgggcccgcngcgccgccaccagagcgagaagtggtagcgaggngtggcgcgtcgccaccatggagggaggatgaccgtgatggacattcgtattcgaccttggcgagaattgacccgccgatataaaatcttgagcaaatgngagaagtacnttgggcgtgtttnggaa

SEQ ID NO: 5017 - DNA, 299 bp, Zea mays
  misc_feature: Incyte ID No: 700349441H1
  unsure 276, 285: a, t, c, g, or other
ggaaagggaaaacgccaccacacgcggatcgaattaggctctccgagtctccggttccctacctctcggcggcggctcaggtccctctccatctccggcgtggcgcttggcgtctgacctcaacaagcaagaaagcaaatggcaggcggcagggttgcgcatgccaccctcaagggcccgagtgtggtgaaggagatcttcatggactgaccctgggtctgatcgcgggaggcatgtggaagatgcaccatggaacgagcagaggaagataggtcntctatgacngcttgacaaggcca

SEQ ID NO: 5018 - DNA, 241 bp, Zea mays
  misc_feature: Incyte ID No: 700349442H1
  unsure 157: a, t, c, g, or other
agaagttgggcctgaagcccggacgctttctcccgagataccgcaatactgctagagcactgtcactaatgtttgcttatgacaatggagtcacctacaactgccgctggtggtgaactggagagctacttctccttgggtttgacatatcccactncacagaaagataatgctgaatttccaaaggttctgttgcttctctcagcgtatcttgacaagacattccagcagaatgaagatt

SEQ ID NO: 5019 - DNA, 303 bp, Zea mays
  misc_feature: Incyte ID No: 700349443H1
  unsure 41, 201, 205, 221, 224-225, 227: a, t, c, g, or other
gcgccggcagtcgccgtcatcgatcgatcgccggaaaactnacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgacgcnagtntgtggacatgaatgcncanncnctcctgtttgatggccgcagtttcgcggcgagcagacccctgatgagctggagatggaggacggcgacgagatcga

SEQ ID NO: 5020 - DNA, 299 bp, Zea mays
  misc_feature: Incyte ID No: 700349445H1
  unsure 2, 268, 271, 280, 292, 295: a, t, c, g, or other
ancttatctagtacttacagaactacaaaaagtttgtactatacatatatggacaaccttataagtggctatgtgtgtacctatcctaacgcttatcccagatggtgtatcagcgtttttctgtgagattgttttcaaacaaggggttgttcattcattgggtcttctcagaaaaaagagaattatgctgcagtcaaccagatggccgttgttgtgccgacatacagggtaaaccaaatgcaaccagaatatatctgcagcggagacntcntagatacantgttttcattcntcnacgc

SEQ ID NO: 5021 - DNA, 304 bp, Zea mays
  misc_feature: Incyte ID No: 700349448H1
tgttattcttataaagttcaaggaacaatcccttctgagcttggcaatttgaagaatctaataagcttcgacttgtacaagaacaacatttcggggacaatacctcctgcccttggaaagttgaagtcccttgtattcttgcgtctcaatggcaatcattgactgggcccatcccaagggaactcgctggaatatctagtctcaaagttgttgatgtttccagtaatgatttgtgcgggacgattcccacgtctgggaccattgagcatatcctctgagcaacttgagaggaaccgggcttgga

SEQ ID NO: 5022 - DNA, 397 bp, Zea mays
  misc_feature: Incyte ID No: 700349449H1
  unsure 64, 74, 86, 92, 124, 224, 231, 233, 251, 253, 256, 258, 266, 270, 276, 286,: a, t, c, g, or other
cactgtccagcttgcacccgacaagccgaacacttcaccctttcccacttcacctccgccgttncgcatctgtngtcaaatacgangtcgcntccataccgtccgtgtttgctcattccctctntcccactcgcttttctccaaagcgagcgagctaggcgttacgcggagctggtttgggcggtggtgaagagagaggaaaggaggagatgaagccgtggacnagcgaantngtgagaacctcggcagantncgngntgcgtcantcgnctgtancggttcttcntctaattaccttcgcntgtctcaanccgagggtctctnaactgangcagtntgtgacagcgcggtcgtctnncncaangttaccnacaggaanncganttcctacccggaa

SEQ ID NO: 5023 - DNA, 406 bp, Zea mays
  misc_feature: Incyte ID No: 700349454H1
  unsure 9, 164, 193, 223, 286, 300, 302, 329, 334, 344, 367, 391, 397: a, t, c, g, or other
gtgtctcgnttgttgacaggcttgatctttcttggagcttataccaacctgatttatttcttgttggaagtttgggactcacatcttaaccttgctgtgtgctgttgtaaaccattgcagaggttgcatgcttaagaaggcatcaagtgttactggctcagctngcatcgaatatttgcttatgtccttgacnattttaaagaacctttactatgcttttgtntgatatctatcttgttattattgagatatcctgttagtcactttaatgcctgttctcgtgacntgtgttaacctcanantatccaatttgtcttcactgattggtntgctncagcctttgncggacagaaagctgcgcacagcnggtggatacaccaaataaagcagntggacnctgagatcg

SEQ ID NO: 5024 - DNA, 407 bp, Zea mays
  misc_feature: Incyte ID No: 700349456H1
  unsure 8, 48-49, 51-72, 83, 122, 165, 213, 279, 306, 309, 322, 339, 354, 361, 366,: a, t, c, g, or other
cgcgtgcntctgtgtcgctcctctcttgtgaggatgaggacgactggnngnnnnnnnnnnnnnnnnnnnnnnctacgccagangcccaggtaggggccattcgtagtcttcttcgtgccttnttcggcgacgagcattcaccagttgctgatgcaaggcttccanagttaacagctcacttgatgcaaaagaacacatcactctaaaggttgnatcgtcattcagagcatgggtcgcggttccatcccatcagctaagcaatggttgtatgtctctggncgactgagcacctaaggagaaggcccntcnttgctcctcggtngcgtacatggcgggacntaagaatctggaganttgaagngttgnctcataganactgtncatggtatcgcctcaagatactcctt

SEQ ID NO: 5025 - DNA, 402 bp, Zea mays
  misc_feature: Incyte ID No: 700349459H1
  unsure 52, 171, 295, 316, 349, 357, 362, 369, 376, 382, 384, 389, 400: a, t, c, g, or other
gaattagtgtttccagttccattggaaaaccttcaggccaggggccagaggngtctatccttgagagcgatgttattaagcaagggatgcctcagatgacatgaccaaagagaaagatctaaacactggggaagctacagaatctgagaagtgtattagtgtgtccccatnggaaagtgataacatggtgtagtgaccccatgagcagggaggcaaatcattctggcatgtgatgtgagaaccaatatcgagggaggtctaaagagcttcaaaatttggagctgtccgtagtggntttcacatcgggttattcagnacttcgcttgagatctaagcactgaaagccgcngctgcatntgtgngtgctgnattaagncccttntnttggnctgtatgtgancg

SEQ ID NO: 5026 - DNA, 420 bp, Zea mays
  misc_feature: Incyte ID No: 700349460H1
  unsure 14, 109, 169, 186, 189, 210, 316, 379, 384, 395, 408, 413, 418: a, t, c, g, or other
cggagaaaggcgcnagcgtccaggttcgagacgccagcacgctctcgcagtacagcagcattatcaggggagcgtgccgtgggagtgggaggttgcctcaggtgcgganagtcgccggcggcgaccatcggtgtctgagtgaaggagagaggcggctctagggcggcanttgacgagcgctacgcnaantggaagtcgctcatccccgtnctctacgactggtttgccaaccacaacttcgtttggccatccctctcttgccgtggggccacagttgagaagtacctacaagaatctcaacgctttactatctganagacgatggatgtgctatatctggtatcgcaatgtgagtgtgaacaaggtgcactgtgacatntcgcnttaagagagcngtcactttgtaanatcanatatntc

SEQ ID NO: 5027 - DNA, 397 bp, Zea mays
  misc_feature: Incyte ID No: 700349462H1
  unsure 2, 58, 90, 116, 146, 163, 168, 183, 189, 205, 209, 212, 228, 232-233, 245,: a, t, c, g, or other
gngacggcgcctttttttttttttatcaagaaccgtttcattctgacagtttacaaanctgtggaaatacctcacagtctttcgaaaganttcagccatccataatttttcattgnggtattcatatagttatgatagttgttacnactagtgtcaatacacncgggngattgggtttcgaancaaaantctggacttttcaatnaagngantcaccaatccctcagnttgnnagtaaaactctngaaaggtcgggaaagcatcggtccggtggtgnagncnaccgccaattgcccgngggtantntggtnnggcttagcttcgttngggtannttgcgctgatcccgacaatttgggctccagtcgngccttngcatggnctcagtnttcaaggcc

SEQ ID NO: 5028 - DNA, 391 bp, Zea mays
  misc_feature: Incyte ID No: 700349463H1
  unsure 40, 107, 124, 156, 177, 182, 193, 202, 212, 224, 233, 257, 273, 285, 322,: a, t, c, g, or other
atctcctgcgtctctgaacttttctgctgtgtctgttggncgggagcagaggttgctacacgtatatattctgaagaagagatcgagatgaccagcgtgtggaagancaaggttctgcctggcntcaacaagatctttgacaaggatggcaagaangctgcagctgcaggctcttgnagtcnttcaacaaggnggagattgncaggagattnagaccagaagangaactggancccaggtcgtgaagctacgagcanctcctctgaggtcagncgttcagatagnagcatcagtcacagagactcgtgcatcacattctcgnggngctagtgnttcctgaccagtgtacaggtgccatcgactgccgttcggncattcntgcagccagtta

SEQ ID NO: 5029 - DNA, 52 bp, Zea mays
  misc_feature: Incyte ID No: 700349466H1
  unsure 25-27, 42, 49: a, t, c, g, or other
gcgtcacgctgaacctcttcacggnnngcggcgatagatctnagccgcnacg

SEQ ID NO: 5030 - DNA, 379 bp, Zea mays
  misc_feature: Incyte ID No: 700349467H1
  unsure 10-11, 17, 57, 172, 222, 229, 317, 343-344, 365, 370-371, 374: a, t, c, g, or other
tcgtcgtcgnngcagtngcctcgcagtttggatcatctcatactcggcgagatgagngagatctgcacatccagggagggcatgtggcaaccagattggcgccagttctgggagtggtgtgcgatgaacatggcttgacctaccgggcggtacatggcattccgacttcatnggagcgtgtaatgtctactacatgaagctctgcggagcttgttcccgcgngttctcnggatctgagcctgggacatggacatgtcggacggacctatgggcagtcttcgcctgacacttgtgttggcatctgtctgtaccatggntagggcataacgagtctgactcatgnntcgtctgagtgtagagactgnatggnngtncagac

SEQ ID NO: 5031 - DNA, 406 bp, Zea mays
  misc_feature: Incyte ID No: 700349468H1
  unsure 2, 43-44, 118, 123, 156, 231, 241, 295, 350, 364, 377, 382, 393, 401: a, t, c, g, or other
ancaaacgatatgccgctgcctgaaccgagaccaccaccgctnntgctcgcctcgcctcacctcacctcatctcacctcgccgactagggttttgtaccgccgtggatctcgccgtcnccgcnatggacgtctcgcacgcgggatcctccgtcgcnggcgaggctccgaccaccggggagcaccggatggggactaccatcgtcggggttgctacgagggcggcgtcgtcntgggcgccgntccaggacagcattggatgtatgtagcaaccgtgctcagacagatattcactgncagacatgtgtagtctgtcgtctggatctgtgtgaacacatcattcggattagtngctattctccacanacacatcactggnaacantacgttaattnagcattgntggtg

SEQ ID NO: 5032 - DNA, 405 bp, Zea mays
  misc_feature: Incyte ID No: 700349469H1
  unsure 245, 332, 353, 361, 378, 387, 390, 392, 403: a, t, c, g, or other
gctgttctgtgaaccaatcatggtgggatgtgtgccgtaggacaaactggcccgaaagagatgaaaacattgcaaacattgtactgtataaccaaagaagcagtatgatggctatggatgtttctgactgtgaagatagcgagcattcggattccatgcatcaaatgtggtatctctgggaaagagttatgagagtccgagaaggtcagctggtatctatctaatgcagagtacagataaactcnggcggatcccatctggcagaaatctagatttgctctagtgatggacatctgcttgcaggatcggtcgatcgttagcatggtggagantgagatcgagagttactctcngagtgagncagagaaggattgctcngtatcagcntcntnatctggcgacntc

SEQ ID NO: 5033 - DNA, 391 bp, Zea mays
  misc_feature: Incyte ID No: 700349474H1
  unsure 195, 301, 306, 324, 347, 364: a, t, c, g, or other
atgcatctcgtaattgtttaccacagtatggaaggagttgttgctggtgctatggattgcgcccgacagcagtgtcaccgcacaataattgaaaagctctcggtgaaggctccatcaggtgattcaaagtaaaagtcttgaaagtattgcccaagagtaccatattgatgggattcatctaatactgaagcagantcacccagaatatgagatctatggacggctcgggatcttcggtccacccagatccagacactatcatgaggtcatgagctcaccattgttctgctccagagttagngcaancatgattcactgtcatgngcgaaacacagtcgcgatctcgnttcacactgagtgcagncgtgtgcataggcagtgtacaggcaca

SEQ ID NO: 5034 - DNA, 402 bp, Zea mays
  misc_feature: Incyte ID No: 700349477H1
  unsure 9, 12, 76, 108, 224, 230, 235, 248, 256, 259, 296, 321, 349, 354, 377, 380,: a, t, c, g, or other
gacgagagnaantatggtgccataggggctcagcagccacatgcatatgctaggagttggcacgatttgcatcaanattgggcccagttggctgggatgtggcagcanatcgtatcagaagggcattccccctgggacaagtttcggcccaggatgggttgtagatggtgaaccacctcaaaactctcatgggctctgcagcatcgactaatcctctctgagcncactgntccanccattatgcatcnaagaatgngtntcgatcacagtctggacgtcttctatgggagttatgngagagcattattagaatcaacatgntctacatcacaacttgatagacctgacntccanaagtacagttcagacgggtacgntcngtgtgtnggcataggncncanc

SEQ ID NO: 5035 - DNA, 396 bp, Zea mays
  misc_feature: Incyte ID No: 700349479H1
  unsure 10, 83, 101, 119, 165, 205, 213, 229, 270, 276, 283, 301, 315, 325-326,: a, t, c, g, or other
ttccaaaaangcaaagcagagcccgcaagcggagaggctacagaagggtatgggtcacttccgcggcctcaccgccgcgcggntcctcgcggcggccttcntgctctccgttgccgtcncggccgccagagcccaggaagaaaccgagcacgaggaggagttcantacgtcgtcggcgacgagaacggggccgagcactgggcancatcaagnagattggggaactgancgccggcggatcagtccccatcgacttttccagacgcgctngctgtncgtcctngtactcaccatctacgcncgcgagcgcatgcnacgggcaganncagtgagtcaggcgagcgcttctgtanaaggnagcnatatnaacaatnatgatgccacganaagtgaggc

SEQ ID NO: 5036 - DNA, 352 bp, Zea mays
  misc_feature: Incyte ID No: 700349483H1
  unsure 90, 126, 188, 270, 275, 278, 289, 300, 304, 308, 321, 336-337, 347: a, t, c, g, or other
gatgtgagctctgtaccattgtgtactgattgtgagcttaagaatgaggacattcagttgcgtctaaactccattagaagacttcgacantgcacgggtcttggagaagaagaaccaggaaggagntgatcctttcttagtgaaacaatgacgatgagatgagtgctcttgcatggctgaggattggngtgtcatccctagttggggtgtagacagctcagtttgctccccctttggaacatgtgacatagagaactggtcgtgataggnatganccngtccgatgtgncaatgaggaangctntcangtctcccatatanagcacacgtatgttnnccggacaccngcttc

SEQ ID NO: 5037 - DNA, 391 bp, Zea mays
  misc_feature: Incyte ID No: 700349485H1
  unsure 41, 54-56, 74, 92, 95, 131, 149, 172, 175, 191, 195, 229, 233, 295, 328,: a, t, c, g, or other
tcgagcgatcggtcgaggttaccttcttctctctctcagtntctcctcgcagtnnngtcgtcgtagcagatctnatctcaaaccctaccgancancagtgttgctcgggacgggaacggagttggattgcnatggcgctgcagtacgtngaagcgcagcggcaggcgcgccngancttcgccgactgtatnttcntcgccgactctaccagcagaagttatggcacaantcancctcaagtcgaccattctacagttccaggcgcacagacggagacattatcattcagtctacnacaattcatcatgatttgagaccagatatctgncagttgccattgcggtgnanttctcgccatacngntaggngtgcatactctagagggtgncaa

SEQ ID NO: 5038 - DNA, 378 bp, Zea mays
  misc_feature: Incyte ID No: 700349486H1
  unsure 3, 11, 14, 26, 28-29, 31-32, 49, 57, 62, 76, 79, 98, 102, 120, 146, 153,: a, t, c, g, or other
aanctgcacgntcngcaaccgtaacngnntnnttggtcgtgcgcgatcncgagaggngcagncatcagttcttggnggngtgtgtatgcgcgtacgtnggcngtgaacagatcggctganccaaggccatggcggaaacggccatnatcgcgngganccttcgnggactcacnttncngatttaaggcgccatnacgcgaagttcgcgtcgaggattcgactggaggnctggactgnagtggattcgactngactttgntcggacggaacntcgnaacgcccngtcnnatngtctcttggcgggtctcagttngagtcgtntcttccgtacgtgtgaggggaggntgagataagatntngatcgnttnaggncgcagg

SEQ ID NO: 5039 - DNA, 402 bp, Zea mays
  misc_feature: Incyte ID No: 700349488H1
  unsure 92, 144, 162, 185, 210, 256, 311, 327, 344, 351-353, 360, 369, 381, 389,: a, t, c, g, or other
caagccgaaggataacaatcctgaaaccaagccatgggtctgcaggaggaatttgaggagcatgctgagaaggcaaagaccttgcctgagancacgagcaatgagaacaagtgatcctatacgggtctacaagcaagccacggntggagatgtgaataccgntcgtccgggctattctaccaaanggacagggccagtgggatgctgganggctgttgaaggcaatcgaggatgaggcgatgaatgactacatcancaagtgaagcagctccggaggaggctgccgcctcttaaagtctctatagtgttgncaacactattgtcagngagttgtgcattcctcntagaagnnntcatcgnccatgggangtgaccagtacngttagtancggnnnatgtcac

SEQ ID NO: 5040 - DNA, 391 bp, Zea mays
  misc_feature: Incyte ID No: 700349489H1
  unsure 183, 219, 230, 241, 246, 258, 263, 271, 289, 304, 308, 313, 318, 320, 322,: a, t, c, g, or other
tgtgcaggtcatcaggaggtctgggtgacaaagttgagaaggtggtggtgtctgatcgcgttgtggactcaccgtgctgccttgtgactggcgagtatggctggaccgccaacatggagaggatcatgaaggcacaagccctgagggactcgagcatggcgggctacatgtcgagcaaaaagncatggagatcacccccagagaacctatcatggatgnctccgcaagcntgcttgactgnatgtnattcttgtaagnatgcnaagttgcngagtcatccatgataggntcctgggtgtctcgnagcntgcgnattgncngntgacagtcntcaggtctctgatctgcgttcngntgttctgctcggttcnctggtgnccancttggnacg

SEQ ID NO: 5041 - DNA, 96 bp, Zea mays
  misc_feature: Incyte ID No: 700349491H1
  unsure 27, 36, 42, 47, 54, 63, 67, 70, 77, 82, 89: a, t, c, g, or other
ctacgcagctgaagagctgatctcacnggcgtcgcnatcgtngtcancttgganagcggcacnaganctntgcctcngcagngtgcttnctggtat

SEQ ID NO: 5042 - DNA, 394 bp, Zea mays
  misc_feature: Incyte ID No: 700349492H1
  unsure 4, 33-34, 81, 86, 108, 146, 174, 215, 239, 284, 288, 319, 331, 336, 344,: a, t, c, g, or other
agtnacactcgctggagcggctcgacatcatgnntgcctatgatcacggacaagggctcgtcgctgtggctcagggttgcncggantgaagtcgtcaccatcgaggcntgctccggcgtggtaacgagggtctcaaggcaattggncggtgctgcgccaactacaggccgtttncgtcagaactgcgcaatgtcgacgaccagggtgtgtctgcntctctgctctgcgacagctcgttngcaaggtcggctcaggttgaaatcatgagcttctctcgcgtgatngtanatgggagtcatcaagactgaactcgctcgcncctgtgtcgcanagggntttggtgngccatgcntcgctgcagagctgagtgatgntgtcgttctgcnggataang

SEQ ID NO: 5043 - DNA, 404 bp, Zea mays
  misc_feature: Incyte ID No: 700349493H1
  unsure 5, 77, 306, 312, 315, 336, 345, 350-351, 368, 384, 401: a, t, c, g, or other
gacangcgtcttcgtatcgcctatctccgcgactcaaagctttccccaattcccccccttctcccatttctcaccancgccgccgctccccccgttcaacaacaccatgagggagtgcatctcgatccacatcggccagctggtatccaggtcggaaacgcgtgctgggagtgtactgcctcgagcatggcattaaggctgatggccagatgccggtgacaagaccatgggggagtgagatgtttcacacttcttcattgagattggcgttgggagcagtccccgtgtgttttgttgacttgagcnatgtcncgngagtgaggatgcactacggcnactcttccnctgannatcatcatggcaggagngccagcaaaattgctntgtcataacatgcaagnatg

SEQ ID NO: 5044 - DNA, 385 bp, Zea mays
  misc_feature: Incyte ID No: 700349494H1
  unsure 93, 108, 169-170, 217, 241, 270, 288, 311-312, 330, 333, 352, 357, 368,: a, t, c, g, or other
gagttcgcagcggcactccagggtccaggcccagcagctcttcggctcttcgttgggggtgcgtggacaccggaaattgcctcggggattgcnttcctgatctaagcncggcatgaagggctgtcagagcgtttgctgtctgctgtgtggcatcgtcgttgttatgtcnntcgtggttgccgcgcacagacttgcctgccgactcgacaacaatgcnacgtggcgcgcctgatgactggangggattcttcccggcgtccgaaatcagtngagggccacagcagaccnctgcttatatgtatacaagaganncatctcgaagagtgaggntgntcgttcatgtgcgtctgcnagtcntgtatgtgtgnctttgtcgctnnagttg

SEQ ID NO: 5045 - DNA, 187 bp, Zea mays
  misc_feature: Incyte ID No: 700349495H1
  unsure 10, 39, 70, 78, 84, 91, 102, 150-151, 154, 167, 171: a, t, c, g, or other
acggagaagntggatttcgggcatgaatgtgctatcgtnagccggcgtggtgctctgacagtctatcgangtcatacngcgctnatgtcgncgtcgcgggangacaagcgtgttctgcgcgtgacacgtggcgtgactgtgtctgtacannacnagtcgagacggantggnacgacttctcggagat

SEQ ID NO: 5046 - DNA, 335 bp, Zea mays
  misc_feature: Incyte ID No: 700349503H1
  unsure 326, 329, 333: a, t, c, g, or other
tggtgatgacattgataagtgtaataagaatcatgtggaatcaccagagcatgctgcagtcatagaaaatgattcttctgtcgagaagtctgtagatgtggttatggctgataatcctgtacattctgaatgtttcaaacactttgatgttctgcaatgtcctctagaccaccactaccttgaaaacacaacccagggtacaggtggaaaaaagtgggtcaaaaaggtacaacaggatggagcatacttgagaagaacctaccagactatatttatgtcagggtatttgaggatcgctggatccttgagagccgtgattgttggancantggnac

SEQ ID NO: 5047 - DNA, 331 bp, Zea mays
  misc_feature: Incyte ID No: 700349504H1
  unsure 5, 239, 283: a, t, c, g, or other
ggganataaatacccaagaataccctttgaaggataacaggtctgcaacatcttggcaggttcctagtgctgtaattgcactggtgtcatctatcttgcgaaagggtgaagatgatctagctcagctatatgccttacggacagtcgataatatatgtagccaaggaactgaatggacatcccgttttgcatctcaggatgcgattggacatctgtgctacatctataaagcaactggnaagcaggagagtacgaggctcatgcaggatcttgtttggccgcntctctcgcttcatccatcatgcatcattatctggaaagatatccatcc

SEQ ID NO: 5048 - DNA, 337 bp, Zea mays
  misc_feature: Incyte ID No: 700349505H1
  unsure 10: a, t, c, g, or other
gatgagtttnggctgttcgcctgtggctgcctttgttccgtctgtgtctgtctatgatgggacgggacacctagggttcggataccggcaccggctcaactgacgacggactatcgccagtggcgatcaccctccctgtcccctgaccgcggcgtcccctgctcgcgccgcaccggtggcgacaaggcaccccttgcctgctacccctagacgcgagcgagcgagccaacacctgttcggcacaagaatggatgggaatgctgagacgatccattctccatggggcaagcgtcgagggaaaggtggtgctaagatggatacacattctttgggtctt

SEQ ID NO: 5049 - DNA, 329 bp, Zea mays
  misc_feature: Incyte ID No: 700349506H1
  unsure 3, 13, 51, 105, 107, 166, 225, 291, 298: a, t, c, g, or other
ggnaactgctgcnattttaacagtagagcttgatgctgctcttggcgggcntgctgttcagtaccgagaaatacaagggaatgaaacagaaaaattcctgtctgntnttagaccatgcatcatgccacagccaggaggagtggcatctggattcaaccatgttgangtcaatgagcaggattacaagacccacttatatgtcctgccatgggaagcatgttgttncatgttaacgaggttcccttgctcgatcatcccttaatcatgatgacatatttatttggatacgantccaaantttccattcatggctcaaatcatccatcagg

SEQ ID NO: 5050 - DNA, 333 bp, Zea mays
  misc_feature: Incyte ID No: 700349508H1
  unsure 151: a, t, c, g, or other
gtagagctggccagctgggagactggtagtacagtggttgcccgtgtagcatgcatgcatgcctgtgtgggtggaccacgacagggattggactcgccgaacaccattttcctgggtacccgagtttcttgacagaacaaccgggatcaanttctctttttgtggcctagcctagaaccgtacccacaatatattttttttataaaaaacgggcagatttcgggtatagtcgtgtttctttttttccatgcttggtcttcggtctccgggtttaatttttcggctcgccagtcgcctctctctatatcatctccttgctgtgtatcatcacta

SEQ ID NO: 5051 - DNA, 333 bp, Zea mays
  misc_feature: Incyte ID No: 700349509H1
  unsure 183-184, 237, 307, 321: a, t, c, g, or other
tatatatcaacagaaggcacttgatatcaatgaaagggagctgggtcttgatcatccggaaactatgaagagttatggggtttatctgccttctactaccgccttcaacacattgaaatggctctaaagtatgtcaaccgtgcgctatatctgcttcagttttcatgtgggctttcacacccnnattcagctgccacctacataaacgtagctatgatggaagaaggcatgggaaangttcatgttgctcttcgatacttgcatgaagccctgaagtgcaataagaggttgctaggagctgatcacntccagactgctgcnagctcaccatgc

SEQ ID NO: 5052 - DNA, 332 bp, Zea mays
  misc_feature: Incyte ID No: 700349511H1
  unsure 59, 126, 128, 130, 144, 171, 174, 317: a, t, c, g, or other
gtccaaggaaacgacgggttcacagccgctgcgctcaattgaccctcccctcgccggcntccggcgatcgccggcatccgagcgatggatcacccatccacgtgatggatccgacagctccttccncngncccccctgcgggcnatggggcacagccatcggaccagaacnggnagcgaccaaggtctgcactccgtggcgccctcggggtggccttccccatcgtggtatcgttctcttctccttcctcgttgggctcgctgggctcgcgcttggtggcctctcgtccatgcatcggtctccagccctccactgcngcatctcttccatgg

SEQ ID NO: 5053 - DNA, 252 bp, Zea mays
  misc_feature: Incyte ID No: 700349512H1
  unsure 17: a, t, c, g, or other
cgcagggagtggcgganggcggggcatcccggcagcggccttcgttgaggacgttgaggcctacctccgccaggtcgggctcgacgtcaattccgcgctcgcttttctccaggaaaggctgcagcagtacaaaatagtggagatgaagcttctagcacaacaaagggatcttcaggcaaagattcctgatatagagaagtgcttggatattgttacaacattacaagctaaaaaggattgggtgaggcatca

SEQ ID NO: 5054 - DNA, 330 bp, Zea mays
  misc_feature: Incyte ID No: 700349513H1
  unsure 2, 225: a, t, c, g, or other
gngcaccagagcttttattgaactcctctgaatatactgctgccattgatgtgtggtctgtgggctgtatatttatggaactgatggaccgaaaacccttgtttcctggaagagaccatgtccatcagctacgtctactaatggagctcattggaacaccgaatgaggctgatcttgattttgtaaatgaaaatgcaagaagatatatccgccaacttccctgtncatgctagacatgccttccctgaaaaatttccacatgtacaaccttagcattgacctagtggaaaagatgctaactttgatccctagacagagataacgttgagg

SEQ ID NO: 5055 - DNA, 342 bp, Zea mays
  misc_feature: Incyte ID No: 700349515H1
  unsure 81, 130, 206, 211, 239: a, t, c, g, or other
gggcaccacggccaccacgggccagaacccgccggcgcacggcggcgtgcaccagcccaccttcaagatcttctgcaaggncgacgaggggtactgcctcaccgtccgcgacggcaacgtggtgctggtncccgccaacccgcgcgacgagcaccagcactggtacaaggacatgcgcttcagcacccaggttcaaggacgagganggcangccctgcgttcgccctcgtcaacaaggncatgggctcgccatcaagcactccctacggccagtcccacccggtgaagctggtgccgttcaacccggagtaccaggacgattcggtgctgtggaggagagcc

SEQ ID NO: 5056 - DNA, 335 bp, Zea mays
  misc_feature: Incyte ID No: 700349516H1
  unsure 126, 299, 319, 328: a, t, c, g, or other
ctcggccacaccctcaccgcccgcgtcatctccgcccgcaccgtcctcgacaagccctccacgcacatcggccgcacccgcgtcgcagagtgcctcgtcggagacagcaccggcaccgtcctcgtncaccgcccgcaacgaacaggttgaccttctgaagccagatacaacagtgatcttccgcaacgctaagattgacatgttcaagggtaccatgaggctggtggtggacaagtgggggcggattgaggtgactcagcctgctgatttcaagtgaaccaagacaacaacatgttcgnggtggagtacgagtggtggngtggacganaggatga

SEQ ID NO: 5057 - DNA, 327 bp, Zea mays
  misc_feature: Incyte ID No: 700349518H1
  unsure 58, 82, 176, 186, 216, 220-222, 228, 242, 290, 292, 295-296, 303, 307, 314,: a, t, c, g, or other
cgcttctatccacaaaccccagccgcagcgtccgtgtaccagtgatgttgccactgcncaccgtgggcgtgggggcggtcgncgcgtcgccggccaccgccgcaggggtagcggcgcccataaggtttcgtccgctccgcctcgtcgcgagtcgagccagcactaccccttcttcncctctacgtncagctcggctatatccagcgcgtcaccagngggnnnattccngcgaagcacctgtngggaagggacggctccccatcgaaaaccagcagccccggtgttcttcnangannaaccctnaagnttcgggngtcnaaagtagcc

SEQ ID NO: 5058 - DNA, 323 bp, Zea mays
  misc_feature: Incyte ID No: 700349521H1
  unsure 39, 99: a, t, c, g, or other
cacgaggaggggtcggccatgacggggaaggcgaaccgnaagaagcacaaggccgggcaggcggaccggctggggcaggacaagggcgggcacgcgaantggcgtgccccctctgccgcaccccggcgcccgacatcaagtccatgcagatccactgccgaggccaccacctccaagcccaagcccggcgtccgcggcagcctcaagaagtaagcttgctggcttggttggctcgcccgcctgcatggggcacattcccttcggtttcaatcccatccgccgacccgatctatatcattcaatcgccgctctcggctggcggt

SEQ ID NO: 5059 - DNA, 321 bp, Zea mays
  misc_feature: Incyte ID No: 700349522H1
  unsure 85, 114, 217, 226, 233, 236, 255, 258, 306, 312, 320: a, t, c, g, or other
taatgttgaatcggcatgtgcttcacttgatatggaacagctgaagaagctctgtgatggaatggatagtaaggatgcagctggnaaggccaggttgctgagcaatgtactttngcaatgaaagttcctcaaaggaagcaaagaaaattgaagggaatggtgtggagcctctgccccaaaatcccaactcctacaggaggtagagcgacagaagccngtaacagcntattgancanctatgagaaaaaagagagnccnggggaaagaagagttgagctgctaggaaagcattccaaagtatcctanggaacntcgggagng

SEQ ID NO: 5060 - DNA, 325 bp, Zea mays
  misc_feature: Incyte ID No: 700349525H1
  unsure 22-23, 26, 30-31, 90, 117, 123, 130, 132, 155, 164, 175, 178, 183, 214,: a, t, c, g, or other
gtctggggctcgggagaagagnncangggnngaaggagggagtgatgctgagcgtggttcgggtacacctgtgcgtcgcgagattcccgntcttgggctgcgagatcacgccgtacntgctantgtggcngnccgacggtgcagtctccactaangatgtcccngaaaccgcgcncgntgatngccagttcatgcggtacagatggtatcgcanacagagnnncngnaaaatgccctatntgcagtgtgcntccatggnacaagcantattcatgcntcggnngtctcaatgcaanaacacctgttgctaaagctnccatgttna

SEQ ID NO: 5061 - DNA, 322 bp, Zea mays
  misc_feature: Incyte ID No: 700349526H1
atctatatgtgacctgcaaaagataaatccttaaatagtaggtcaattgcgaagatttgttagtgatgatccgatgatcaagaaccggagcaccttcaagattggaactgcagggtggtcgggttctcagataagaatgaatcatagaaagttaatgtgtgcatccatggttgtggtcttgacacggcggagcggacctcgctcgggaagctgctgcagccggtagactattgattggaattatgtacctaaaagttctccacatgtagatgagtgttatcgtcatagatatggggtcatcccgttttgttcccaggttgaa

SEQ ID NO: 5062 - DNA, 327 bp, Zea mays
  misc_feature: Incyte ID No: 700349527H1
  unsure 136, 265, 277, 312: a, t, c, g, or other
caccccgcacggtcgatctatcttgttatatgcgtgcatggaggggagcagcagccagctgctggagacctgccttcctgctagcctctacgcggttactcctcctccatgcgcccatcctcatccccttcttgcnccgctgccgaaccagcagcacatgcttctgcagatgccgtttgtacaaggagcaggctgcgaataatcatggcctgatgctctcttcggaccaccaccaccacagcggcctcctgtacccgctgcttcntcccggcatccnttctgcccctccgtcgccgccgcctgcgagaagantaccaccacggctcc

SEQ ID NO: 5063 - DNA, 323 bp, Zea mays
  misc_feature: Incyte ID No: 700349530H1
  unsure 137, 200-201: a, t, c, g, or other
gcttcctgctaacagttcgttctcaaagcacagcttagcatacatgcaagcaagtggctcagtatatcaagcaggtgtctggctattaaaggtcggtgtaactactctgcggagcagttcagcctatgaagcaccanaagaaacatactcctgccagttgaggcttaaaagttcacctgaagatgatgtggtacctatgnngccaggatctggtgaaacacatgtctctttcctgatagcctcggagatgattgatcatcgatgtgtctgattcaagggaaagtcttgtggtcgtgttgttgcccagttgctacatggctgag

SEQ ID NO: 5064 - DNA, 328 bp, Zea mays
  misc_feature: Incyte ID No: 700349532H1
  unsure 2, 253, 289, 307, 310: a, t, c, g, or other
gncagctagcaactcaaaggaggaagactagaagatatatagccttctccttgtgtgacacttcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactatnaacagcatcatggacagttggctgaagtgttcgacnggtctcagtccacaaacnccntataaatgccgagttcgc

SEQ ID NO: 5065 - DNA, 320 bp, Zea mays
  misc_feature: Incyte ID No: 700349533H1
  unsure 36, 316: a, t, c, g, or other
cgccggcgtgctcgtgatctcaacccaaggcgtgcntccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgacgtgacgagtcgtcacttacgctgctatgcttgctgctcagacgtcgcaagcgctgnagga

SEQ ID NO: 5066 - DNA, 324 bp, Zea mays
  misc_feature: Incyte ID No: 700349535H1
  unsure 177, 252, 319: a, t, c, g, or other
aaagttgatggaagctgctaaatccaatgaagatgcactaaggaagacttctaacgaactagaactgaagcttaaatcccagtgattatgtgaaacaacaaatgctggaagaaatatctggcctgaaacttcaggctcagaaaataatgaatcttcaagatgaggtttccaaacttncagagttctcttgatgaggccaagttcgaaaaagggaaactgaggagtttctgcgctcggtgactgaggaatgtncaagaactaaaagccacagaaggctatgctaacagataaagtttcttatatgcaggagacctgaganatggg

SEQ ID NO: 5067 - DNA, 318 bp, Zea mays
  misc_feature: Incyte ID No: 700349536H1
  unsure 2, 33, 71, 127, 131, 236, 297, 309: a, t, c, g, or other
gngagccacagaaggcaactggaggtttgaggncggcgcgataggcgagccggcgagttcgggtgcttttnctggggtcggagatgcgaccgttgggacctgggaaacagcgcacttcgagttcggnggcngctcccgcgacggcggcagccacctgagcaggatgtttaattggaacgacgagcagcagcaggcaggggatgcaatttgggctgagttcaatgacagtggggacnatattgtgccaaatcctaaaggtgtagaagatatacattagttagtgccaggacctcaagnaccatgaggaanagtggctat

SEQ ID NO: 5068 - DNA, 99 bp, Zea mays
  misc_feature: Incyte ID No: 700349538H1
  unsure 74: a, t, c, g, or other
gtcacactggtgagctctgcagtctgcactctgcttagctccgagcttcagtgccttcgttgttagctgttagntccacagtccacagttccacacaac

SEQ ID NO: 5069 - DNA, 307 bp, Zea mays
  misc_feature: Incyte ID No: 700349541H1
  unsure 2, 179, 233, 249, 272, 276, 284, 292, 301: a, t, c, g, or other
tngacgggtttgaggcaaccggacaaataaggcaaatggagttgaaagcgaacgcggaaaggaagaacaagttggctccgatcgaaggcgcgacaactgccgagtaccatctgcctgttctggcaatgacagccgatgttatccagggcaacttacgaagagtgcataaatcgggaatngatggatacgtatctaaaccctcgacgaggagcagctataccagcatctccagntggtatgggaacgacngttcggctgtttgatgttcaaanacgnggacggantctcatcntcgatcgantgagca

SEQ ID NO: 5070 - DNA, 305 bp, Zea mays
  misc_feature: Incyte ID No: 700349542H1
  unsure 249: a, t, c, g, or other
gggatcactggtattattaagaggccaaagatttctggagcacagcttgtagccatcctacctctggctattgttcatactatgggcatctcttcaccaacatgagccttgggaaagttgcagtgtcattacgcacaccatcaaggctatggagccttctttctgttattcttctgcaattttcctggcgagttacctactatttgggtagtatcatctctcttccattgttggtggtgttgcatggcntctctactgaggcatcctttaactgggcggctttggagtgcatggctcaatgttac

SEQ ID NO: 5071 - DNA, 318 bp, Zea mays
  misc_feature: Incyte ID No: 700349543H1
  unsure 55, 79, 163, 171-172, 212, 214, 267, 270, 313: a, t, c, g, or other
gctcctcctccccgccgccaggggctaggacgaggcaggagacagaccgacagcnggcgatgttcaccgccgacctgtnagaaatggagacggggcccgagcaggaggcgccggcggaggtggatcccttggtggaatggtggctgctgttccggctccggtncaagaagnngcggaaccttccccaagactccagatccgggcgattgcgntnctcgccgaggacatgctgtccacgaaccgcttcgtgtgcaaggtgtgcggcanggntctagcagaactagtgctgcattgcaccgccgcggccacaacntcctt

SEQ ID NO: 5072 - DNA, 310 bp, Zea mays
  misc_feature: Incyte ID No: 700349544H1
aacaaacatggccagtgcttggaaatgtgagttctgtcattcttcccaagttactgagtgtactggccctttgtcacattatttgaatggggagccagtagaagctgatcaagcttggaaatcaagtgttcagcatgtccatgagaaatgcattgaatgggctcctcaagcattcttactggtgacaccgcaaacaacttggggcctgagttggcccgtgctctaagatcaaatgcatgtttgtggctaaaaggcgcacacttggctgcctgtgaagagctgccgcaaaagttttcagtcccagtgccta

SEQ ID NO: 5073 - DNA, 307 bp, Zea mays
  misc_feature: Incyte ID No: 700349545H1
  unsure 16, 24, 32, 38, 47, 57-59, 65-68, 71, 76, 101, 120, 148, 186, 189, 191,: a, t, c, g, or other
ccgactatttcgggtnaaccaaanagcgagtncaaggncaaagagangaagcatacnnngcatannnntgngcagngggacaacgacaaggaacctacgangcacgaacatcggcatagngatcggagtaaggacaaagataaagacnaagacaggataagaaaaaagatcagagtggtcatctgncgncngattcaaagaaacatctgaaaagcnagaggaagcacgnnggaatgatgttcgcagtgtgcnagccaagangatnagcacagagttncnaaaccgtgagngggganggcctntnttc

SEQ ID NO: 5074 - DNA, 319 bp, Zea mays
  misc_feature: Incyte ID No: 700349547H1
  unsure 106-136, 287, 291: a, t, c, g, or other
gtctccccatccacctgtcactcttaccgccagccccacatcacggagcatcccccccttaataacagcaaactaccacacccatgtccacctccgtctccgtctnnnnnnnnnnnnnnnnnnnnnnnnnnnnnnntctcgtcccacccctcaccggccgccggtcgccgccggcatctcgcgtaccgcagatttgccgcagaagaatcagatccaaaccccgtatcttctcttcttcccctccttccccatgtccccgccgctgccatgggcaacggcggcgcggncccnacgctttcgatgcgggtcaagaagaatt

SEQ ID NO: 5075 - DNA, 287 bp, Zea mays
  misc_feature: Incyte ID No: 700349549H1
tgatgtagcatgtgggtgtggaagtggcggattagcctccgcagaagcgttggctgctatcggccgtagttaaggttgatggcgctgaaaataatgaatatgacacaaaggatgccgatggggaggggcaagaggcgggttcaggtgccactgaaggcagtgataggaggattttactaaatcgtgttagtagtggcatatagagtaggatcgcaacgtccaacgccgacgtcgacaacaacagtcatgggggtatcactagattgctccgccacatcaagacctag

SEQ ID NO: 5076 - DNA, 279 bp, Zea mays
  misc_feature: Incyte ID No: 700349550H1
  unsure 278: a, t, c, g, or other
aggaaatgcaccactaacagctgttcagcttctttgggttaacatgatcatggacacccttggcgcgcttgccttagccacggagccacctaatgatgacttgatgaagagagagccagtaggaaggacagggaaattcattacaaatgtgatgtggaggaacattcttggtccagtctttctaccagttcttgtgatgtggtatctccaaacgcagggaaaaactcttgggctgaaggctcggtactgatattgttcgaatacatattttcaactcnt

SEQ ID NO: 5077 - DNA, 283 bp, Zea mays
  misc_feature: Incyte ID No: 700349551H1
  unsure 217: a, t, c, g, or other
gttctctgcaaggtggtcaatgtagaacttagagctgaaactgattctgatgaagtttatgctcaaattatgctgcaaccagaagcagattcaaagtgagcccaccagcccagattctgagccaccggagcctgaaagatgcaacgtctattcctctgcaagacttgactgcttcagatacaagtacccatggtggattctctgtcctcaggaggcngctgaagaatgtttgccccaactggactgactcagaatccaccaggcaagaatgctggctaaagac

SEQ ID NO: 5078 - DNA, 277 bp, Zea mays
  misc_feature: Incyte ID No: 700349554H1
  unsure 31, 257: a, t, c, g, or other
gggagctcaaatccacatgatgatgagaganaaaaggtgcgacagaattgcttgtaagaagagagaattgcaccccccagaatgtgtggctcatcttgaagaagcaaatgcccatgtcgggtttcaccagcgtttagcgtgtactgatacagctctgtagtaattctagttgctgtttgtctatcgaggtttgagccggtagcatcctcctctctttttgttttcctaatttgaatagttatagacagacaggtttncaggaaaagaataacagttt

SEQ ID NO: 5079 - DNA, 283 bp, Zea mays
  misc_feature: Incyte ID No: 700349555H1
  unsure 204, 216, 244, 260-261, 265: a, t, c, g, or other
cgacgatggcgagcggcagcatgaagagggagatcagcgagacccacgacaccctccgcttcggcctcaatgccggcgtcaaggccgacctcgcgccgccgcacccgctccagttccagcatccaatcggaggccaagttctgggcggacaagaagaagtttgggatagaggccatctacggatccgcttgaacatccgcaagntctcgatgcccnaattctctcaaggttcccaaaggccccnggtgtttgccatcatnnctgntggatatgaggcatgaca

SEQ ID NO: 5080 - DNA, 282 bp, Zea mays
  misc_feature: Incyte ID No: 700349556H1
  unsure 12, 41, 95, 258, 260, 276-277, 279: a, t, c, g, or other
ctttcgccggcngcgtaggaagagatggcagagcgtttganccgtatcgccatcgtcagcgaggacaagtgcaagcccaagaagtgccgccaggngtgcaagaagagctgccccgttcgtcaagactgaaatgtcccatttgatgccattgaaatcatcaaccttccaaaagacttggaaaaggataccactcaccgatatgggcctaataccttcaagttgcacagattgcctgtccccagggctggtcagtttggncntttggaaaacaaaggnntngaa

SEQ ID NO: 5081 - DNA, 286 bp, Zea mays
  misc_feature: Incyte ID No: 700349557H1
  unsure 37, 173, 180, 184, 187: a, t, c, g, or other
ctcgccactcatccaaccaccgcccaaacgtcctcantccataggggatgacctctatctcgcccgaaaccggcttctgccgccgccggcgggggcaaggtcatgcctttccaccattaaatggcccttctccgttccagctccagccttcgccaccgctgtcccacggggcnttaaaanaaanggnctgcggaggcggcgcagagcagttgctggacgagctggcggcggcggcaaaggccgccgaagctggcaattccatggcgcgcgagagatattggcgcgg

SEQ ID NO: 5082 - DNA, 281 bp, Zea mays
  misc_feature: Incyte ID No: 700349559H1
  unsure 34, 42, 166, 259: a, t, c, g, or other
ggcgaaccaaacctcggagaaaccctagcaaggncgcttgcncctctcaggcgcgacacagcatcggcgactagcgatgacaggatatcgcagccgcagttccgagccgaagctacagcccacggaggcggtacagccggagccctcttaggcgcaaggctacgangacccacgcgaccgctaccgctgggccggggccggcggaggcggggaccgacgtggttacggtcggccttggcgcagtccggtctcctcatcngtaatatctccctcacagccag

SEQ ID NO: 5083 - DNA, 276 bp, Zea mays
  misc_feature: Incyte ID No: 700349560H1
  unsure 5, 7, 27, 38, 41, 59, 115, 182, 193, 209, 232, 265, 267: a, t, c, g, or other
gggancnaccgcgatgtcgcccaagcnggcgaaggacnacncgccaccgagttcgaganatgcgagctgtgccgccatcaccacgaccatggccggcgcccatcgctacatcgtnaagcacaggagaaatctcgacgccgcgctcacctccttccgctccaagctctccgactccgcagcgnttctccccggntcccctcttcccagcngcggcggacccgtctctggtgcncttctgctccatgactcgtcgacttcgacagcngntccgtggta

SEQ ID NO: 5084 - DNA, 280 bp, Zea mays
  misc_feature: Incyte ID No: 700349561H1
  unsure 152, 160, 182, 186, 188, 190, 192: a, t, c, g, or other
tcatatgttaatgcaccattgcagaaggagctgttggctgatgaggtggggaacacagctgcattcctggtttcttcattggcttctgccatcaccggctcgactgtttatgttgacaatgggctcaatacaatggggcttgcaatttgacnagccctanccataacgtcatagatgtggtnttgnananangaccgactttccctgctgcatgcggtatcatcctgaataaagatcatagttagttataaatagagaggtaagggcagaaaggggaaaa

SEQ ID NO: 5085 - DNA, 277 bp, Zea mays
  misc_feature: Incyte ID No: 700349562H1
  unsure 42, 225, 252: a, t, c, g, or other
ggctccgtcgtcgcgtgccatcctagggtttctttccccgtnggcgcctccccagatttggccgccgccgccgctgacccaggttgtcttgatggcgcccgctgtagaagccgtgaaggagacaggtcaccttccagaaggttcctgccttgaacgaaaggatactgtcatccatgtcccaggaggtctgttgctgcacaccctggcagatctggagataggtcnggtgctccaaccatattcaatgcgtcntgagataccaagggcagcaggttaa

SEQ ID NO: 5086 - DNA, 280 bp, Zea mays
  misc_feature: Incyte ID No: 700349566H1
  unsure 253: a, t, c, g, or other
gactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaaccttcatcctcaaggttgttgactccaagatggtcgtccagagaggccgcgaggagggccccagggaagacagatgaggntgcggatgttggttggtgtgaaaccgg

SEQ ID NO: 5087 - DNA, 274 bp, Zea mays
  misc_feature: Incyte ID No: 700349567H1
  unsure 254: a, t, c, g, or other
gggagggtccatgggcagctatggccacaacaggcatcttccttgctgccgcagtcactgattggctagatggttatattgctagaaagatgcagctaggaacaccttttggtgcatttctgatcctgtggccgacaagcttatggtagcggcaacattagttttgctatgcaccaaacctttggaatcatcactgctcaatgatgggccaggctctaacagtccctccatgccatcatggaagagagatacangtcagctgtgagagatgggc

SEQ ID NO: 5088 - DNA, 284 bp, Zea mays
  misc_feature: Incyte ID No: 700349569H1
  unsure 59, 144-145: a, t, c, g, or other
gcaacactgccatggccaccgccgctgccgacgacgatgtcaagctcgaatccttcctnccaatggctccagtcccaacggcgccgacctccgcagctgcacgatccgcgcatgcggcggcaagggcttgggcgtcttctccanngccgcccccgagccgggctccaacgacggggtggcgatggtggtaccgctcgatctcgccatcacgcccatgcgggtgctgcaggacccactcgtcggcccgcgatgccgcgcgctcttagaggacggagtcgttcgac

SEQ ID NO: 5089 - DNA, 261 bp, Zea mays
  misc_feature: Incyte ID No: 700349570H1
  unsure 25, 42, 52: a, t, c, g, or other
ctggtttgttggagcagatgctgcnacaggctgataaacagntggcatacanccttcttcttgctgaaaacatttgccagaaacatggcgttatggttgagaatctgtatcagaaatcgttgacatgggactaggaaaacaaatatctaaaataagaccatccctttcatttattggagcagaggaaataatgagtcgtgtgacagcacaagttgcggaaagtagtgagctgaatgaagtatggaaggatatcctgaacgc

SEQ ID NO: 5090 - DNA, 279 bp, Zea mays
  misc_feature: Incyte ID No: 700349571H1
  unsure 35, 37, 68, 189, 200, 243, 266, 269: a, t, c, g, or other
gcgcctcgcctcgagatccactcggagggccaccncnaccgctccggtcggttccggcgaggtgccgngcggtcgtaagtcgtaacagcatacacagggcagacaaagctgcgattttgggggggctgttggtccagccgtggttgttggtggagataaaccacgtgaaggctggtgctctggtacatnttccgccaggnactgatggcattggccgaggtggaaagatggacgccgccggcntcctccatcgtcgtcgtcgttcncgntctgcacaac

SEQ ID NO: 5091 - DNA, 277 bp, Zea mays
  misc_feature: Incyte ID No: 700349572H1
atctctgaaggtgctcaagtcctctggtcgtgcacctgaactagaagcatggaagcaactgtttattaccctggaggaccggatacgtacccatcaacagggcggttatgcaacaaatcttgcccctggaaagattgttggaaagcttttcacatcacttgataaatctttgtcccgcatgatgggtacacaatctgcaccgttgcctcaactgccgcaggtgctgcaaatgagagaggtgtttatctctcctgattacaaaagtagtaaatagtca

SEQ ID NO: 5092 - DNA, 276 bp, Zea mays
  misc_feature: Incyte ID No: 700349573H1
  unsure 2, 91: a, t, c, g, or other
gncatccactggtggtgcccgggtttctaggtgacagtcttagttgaggaacacacttgtacttccagtgctagaaggaagaccacgagtncctactagctcttgggtagcatcaaaggctggttttttctctgcacaggttgaggacatcacaaacactcacaatagacatgtagtgaagtcatatttgcatgagtgtacatgcctcgagtggcagcacaccggcaaacctgcccacatgcatggcctgattataacacaggagatgtggagtgg

SEQ ID NO: 5093 - DNA, 267 bp, Zea mays
  misc_feature: Incyte ID No: 700349574H1
ggcatcggcgaggtctgcaaggccatcatctgcctggagatcgccgcgtccaagttacaggtgatatttgaccgggcggaggctgtgcgtatgagcgggatgtctgagaaggcgtacatcagatcattcaattcgctccaaaatggtctggtgtcaagacgactttggatgtgcgtgaattgggcatccagtttggctgtgtcaggctgataccttcgttcagaaggatgtcactctataaggagcgctcctgctgcatgccacctc

SEQ ID NO: 5094 - DNA, 270 bp, Zea mays
  misc_feature: Incyte ID No: 700349575H1
  unsure 2, 125: a, t, c, g, or other
cngtactctctcaacttatggacagattgtctaactatgctgcctcaagtgcctgaactgttgccagagttctgcaagttgaagcttttgctaagttcagtaatgctattggaaaggtgatagangcccaacctgacatgccagttgttggagccataactctatatgtatcacttctgaccttactctccgtgtacatccgatcggctgattatgttgaccaagtgcgggtgcagtgtcaagaaacttcaggcaaggcaaaactgaaga

SEQ ID NO: 5095 - DNA, 146 bp, Zea mays
  misc_feature: Incyte ID No: 700349577H1
  unsure 127: a, t, c, g, or other
gtgagaaactttcagtgagcgccttctgcaggcggagacttgcaacagttatggtgaagctcaagtttgcagagcaccttaaggaggctgtgacgtacattcgaacaggggcacgtgcgtgtcggtnccagatgcagtccacggac

SEQ ID NO: 5096 - DNA, 273 bp, Zea mays
  misc_feature: Incyte ID No: 700349578H1
  unsure 220-221, 230, 258: a, t, c, g, or other
ggaagctagtgggaccagtaacatgaagtttgcattccagcagtactgatatgctgtgacaattcactggcaggaattagcgcctcggcaacactaacattatatcagtactgctggaatggaagctagtgggaccagtaacatgaagtttgcaatgaacggttgcattcctattggaactttagatggtgcaaatgtggaaatcagagaggaggttggnngaggaaaantttccttttggtgcagaggcacatgaantgctggtttgcggaa

SEQ ID NO: 5097 - DNA, 279 bp, Zea mays
  misc_feature: Incyte ID No: 700349579H1
  unsure 53, 126: a, t, c, g, or other
gggaagcgagagccgagagagacaggagatgctttaattcgaacgcggttgcntcctccctcgagcccttctccttccttcctaccccccacagccacagtggcatatcgcatcacgccaaagccnatccgccggccgtagatcggctccggcgaccggcttcgaccgcggcctcccctctgaggattttcggcctagaggttccccatggcatcagttacttatatgatgatagccatgctgaggttatgatcctccaaagaatgaggaaatgctgga

SEQ ID NO: 5098 - DNA, 279 bp, Zea mays
  misc_feature: Incyte ID No: 700349580H1
  unsure 2, 43, 66, 85, 233: a, t, c, g, or other
gnaattggcagggaattccaacacagatttgtgctcgaccgantcgagagtttgtcgacgcttgangaaggacctaatgtgagcntttacacacttgatgaacagcttgagctcttgagcaaggtgggggcatttttgtacccactggtcgtagttttgttggctattactaatcgtgtgcagatggccccattcacctctaccaacaggtgttgaatgcaggggatgacatnattggtgttgagttcttagaagaagatatggtggcaaggttctatt

SEQ ID NO: 5099 - DNA, 277 bp, Zea mays
  misc_feature: Incyte ID No: 700349581H1
  unsure 155, 215: a, t, c, g, or other
gtttgtgaagcgacacagtctccagatgtgaagataaggcaggctgcttttgagtgtttggtggctatctcgtctacttattatgataagctggcaacatacatgcgggatatatttaatataactgcaaaagctgtgaggggagatgaggagtncagttgcgcctccaggctattgaatctggagttccatatgtgatgaggaaatcgacattnctggatgagtacagcagtgaattacagctgattctgatgttcctgctactacttatcaagca

SEQ ID NO: 5100 - DNA, 276 bp, Zea mays
  misc_feature: Incyte ID No: 700349582H1
tgattactatgagtactttggccctgattatactcttcatatccaaccaaaaagtgttgaaaacctgaataccacaaaggacttggagaacataaagaacatgatattggagaacctgtcaaagatagaacatgttcccagcactcaattccatgacagaccgtcagaccctgaagctccagaggagaaagaggaggacatggacaagaggccacctcagcgcacagattatggagcggaggagcttacgactctgatacagaggatcctgacagc

SEQ ID NO: 5101 - DNA, 269 bp, Zea mays
  misc_feature: Incyte ID No: 700349585H1
  unsure 166: a, t, c, g, or other
gtttatggaggcaggagacctcgacaaggctttaatgtattataaggaagctgttaagcttaagccatctttcgctgatgcatatcttaatcaagggaatgtttataaggcttgggaatgcctcaagatgccattatgtgttatcaacgtgcactgcaggcacgtncctgactatgctatggctatggtaatctgctactatttactatgagcaaggccagctgatatggcaattcgttgttacaatcaagctatagtctacgacccac

SEQ ID NO: 5102 - DNA, 273 bp, Zea mays
  misc_feature: Incyte ID No: 700349586H1
  unsure 3, 60: a, t, c, g, or other
ggnagcaggatgtcgatatcgagaaccagtattacaactctaaaggtttggttgagacanacccagagggtgcacttgctggttttgatcaagtagtcagtatggagcctgaaaaagctgaatggggatttaaagctctaaacaaactgtcaagctttactataagcgggaaaatacaaagaaatgatggatgcctatagagagatgttaacatacataaatctgctgtcacccggaactacagtgagaaatgtataaacaacataatggatt

SEQ ID NO: 5103 - DNA, 275 bp, Zea mays
  misc_feature: Incyte ID No: 700349587H1
  unsure 2, 151, 158, 160-161, 166, 201: a, t, c, g, or other
gnaaagatgctccagctcatcctaagttaaactcaatgaagctgatcgaaggatatttcatgagagctggttttgtatcagcatttaaagatatacatgagagactggggaagtatggccaaaaaagttttccaggttagctctgttgtcnagaggangnnagggntgaggttatcaaggctgatatacaaggaaggaagnaaaaactggagagatgaagaagaagggtattgtcacagcaagaaattctaaaacaagagcacgacgaggaaatt

SEQ ID NO: 5104 - DNA, 87 bp, Zea mays
  misc_feature: Incyte ID No: 700349588H1
  unsure 30: a, t, c, g, or other
tagggaaccgtagtccagagaacgtttgtnaaggtcagtacattttatctgatcgttacagtgctgatgaacaaactgggcgcaaaa

SEQ ID NO: 5105 - DNA, 267 bp, Zea mays
  misc_feature: Incyte ID No: 700349593H1
  unsure 38-39: a, t, c, g, or other
tgtgcaggcgaaggcggcgcgctaccggcgacggccgnngggggatacggcgacatcgtccccctcgacccctcctccatccccgacgcggcggcgccagactgcaggtgttgaatgctgatttgttgtggcctgttgcgtcttcaccagttcatacattaaacttgaagaaccacgtggttgaagaaaagcccactgaaaatgagtatacatcatcttcgtcagtggtgagcgtgctatgcagtgacagagggctgtggagatcaa

SEQ ID NO: 5106 - DNA, 272 bp, Zea mays
  misc_feature: Incyte ID No: 700349595H1
  unsure 87, 147: a, t, c, g, or other
ctcgcgcggggagccctcccgcgtgcccacgcggaggatcccgtcgcggctggtgcactaccacctcctctccattcgccactcccncgtgctctctacgcgcgtcccctcgaccatagatagggtttgctcccttccttcctcgcngcccgatttgatctcgtcccttccgggctccggctaggctgctccgtctctcctcctccgccatgttctcgcacggcgctgattccgcccacgacgcgggaccgttggcgtcacagcggcgtcgg

SEQ ID NO: 5107 - DNA, 273 bp, Zea mays
  misc_feature: Incyte ID No: 700349596H1
  unsure 31, 49, 79, 111-112, 151-152: a, t, c, g, or other
cgggcgtgcctcaagtgctgcggcgtctgcngtgcgtgccggcgggcantgccggcaaccagcagacctgcggcaagtnctacaccgactggaccacgcacggcaacaagnncaagtgcccgtgactccttgtccttgatgagagcagcannagtccatgggcggcgggtgcgccactgcccacactggcgcgcacgttttgtatgatccgaccccgtcggcgtagatgtgcgagcctgtagctatctagcttagatgtacgaggttgatgtg

SEQ ID NO: 5108 - DNA, 125 bp, Zea mays
  misc_feature: Incyte ID No: 700349601H1
  unsure 2, 18-19, 35, 48, 54, 56-57, 63, 67, 91, 103, 117, 120: a, t, c, g, or other
gntctgtgggctgaaganngtgctgtcccctgaantcatccagatgcngcaggngnntggctnccgnataagatgggtcaacaagcctctngtctacaaggantagaccacctgttnctnatcgt

SEQ ID NO: 5109 - DNA, 293 bp, Zea mays
  misc_feature: Incyte ID No: 700349603H1
  unsure 232, 236, 244, 250, 278, 280, 284: a, t, c, g, or other
ctgaggttaaggccccaaagattgaagaagcttctcaatctggagatcgcatatttgccagccctcttgctcgtaaactggctgaagataacaatgtcccactatcaagtgtgaaaggtactggtcctgatgggcgtattttgaaggcagacattgaagattacttggccaagggtgggctgagggaggcttttgcagctccagggttaggttacgttgatattccaatgcnccgntaagaaangttacngcaaacccgttgctagcatctaaacagncntccncattactat

SEQ ID NO: 5110 - DNA, 293 bp, Zea mays
  misc_feature: Incyte ID No: 700349604H1
  unsure 87: a, t, c, g, or other
gacttgcaactctatgtaaggttgcaatcggatctaggcagctatggttctgaaagtgatcaagagattgccaaatccatgctttcngactgcaggacaaaagtagggattaacgatcatcgagtgcttgatgttattgcctctgcactttctaatttcattgagatgggcaaggatgtaatagtgaaggagctgactgagttgttcacgcctgaagagatgcctctgtttgggtcgaattcagcacttgactgggccaacttcaatgcacaagcattttctgatgaatccct

SEQ ID NO: 5111 - DNA, 287 bp, Zea mays
  misc_feature: Incyte ID No: 700349606H1
  unsure 276, 279: a, t, c, g, or other
ctcttgtcaagtacataaagggagttggaaacatgagccatgagcaatggcggtcgttccataacgacaagaagacagcggaggcacggaacttccttgatggtgacctgatcgagtcgttcctgaccttagccggagcaagatggaggtggtgtccaaggctatgggcgtttcggtggaggatctgtccaagattgtggaagagctgacgaggcttcactagtacatggatacgcagaagcttgcttgtaacttgatgcatgtacatcccttttngcnatctattt

SEQ ID NO: 5112 - DNA, 259 bp, Zea mays
  misc_feature: Incyte ID No: 700349608H1
gcgatctaagcgaaactatagggtacccccaaatgaagcaagggatgacagtgctaacagcagcgagggtcacaacgtgtcagcctcgatgatggatgcaatgaaaaagataaacaaggataaggtgaaagcggccctggagaagcggagatcaaaaggtgacctttcgagaaaggttgatgtgatggatgatgatgacctcattgagagggagctggaacatggcgtggagttggcggttgaggatgagaaggtcaag

SEQ ID NO: 5113 - DNA, 276 bp, Zea mays
  misc_feature: Incyte ID No: 700349610H1
  unsure 2, 17, 21, 26, 30, 62, 81, 90, 104, 109, 118, 139, 147, 154, 170, 216-217,: a, t, c, g, or other
cnggtgctgttcttgcntccnttgcngggntgggaaccttgagttcctcctatctgtatctngggttaagaggcgtttttnccccttatnttctggcgactggnttctngtggtcgtntgcgcgcccccaccttctgtntgactggngtttggngtcctgtggtgattcncttcgttctctctgtttctggaggaggataccattttggatcttgnnggagtatttaangggnanactacgtctgcnttngcccnaatgtggatntactgncttcg

SEQ ID NO: 5114 - DNA, 288 bp, Zea mays
  misc_feature: Incyte ID No: 700349611H1
gataaaacagggacgcttacagaaggaaaaccagtagtgacttctattgcttctctggcatatgaggagacagaggtccttcgtcttgctgctgcagtggagaaaacagcattgcacccaattgcaaatgctataatgaacaaggctgaactactcaagttggatattccgatcacaagtggtcagcttacatcgcctggatttggttgtttggctgaagtagatgggagtttagttgcaatgggcactttggattgggtgccatgatcgttttgaaactaaacctcc

SEQ ID NO: 5115 - DNA, 288 bp, Zea mays
  misc_feature: Incyte ID No: 700349614H1
  unsure 2, 10, 39, 86, 116, 142, 148, 151, 169, 188, 190, 200, 220, 230, 266, 278,: a, t, c, g, or other
antcgagggnagctttcatcagcttcttctgttcctgangtcaagttatctcagtacatttcagcattggagaagctgacaacatngagagtgctacaacaggcctcttgtatttntaaatccataaagattgatatgcgcncaagantgnttccatctttgacttctntgtcgtggagaagatttcngntgatgctgcnaaacaaaattttgttgctanaaaagttgancattatcgggagttgttcactttgggaatgtggacnatagaattctgnatggnttaag

SEQ ID NO: 5116 - DNA, 289 bp, Zea mays
  misc_feature: Incyte ID No: 700349615H1
caaaaaagctgaaggaactagagaaagaagcttacagattggcaggcaagaatttctctctaaatgctactgctgatatcgcagacattctatatacacacctaaaattgccagttccaaaaggctgtgagaaagggaagctgcatcctagcactgacaagcagtctttggaccacctaagggatcaacaccccattatcccattaattaaggaacacagaacattagcaaaactgttaaatggcacgttgtggtccatttgttcacgtgctcaattgtgcactcatcc

SEQ ID NO: 5117 - DNA, 290 bp, Zea mays
  misc_feature: Incyte ID No: 700349616H1
  unsure 83, 98, 125: a, t, c, g, or other
atcggcgagcctgcagtcagacttaccaccaagtggacgcagcagctttaaccccccaaagcctacgacgccgcgagcacagntccgccgccaccgcncccttctcatccgcggtctcctccgcntgctgcatctctatcgatctagcgggactggctccttcccgtgctgggtccttcgtcaatcgtcagcgcgcaagatcggcacttgtgtacatctgagcagtttccggtgccctaattcaggcgcgggcgttgttgggttttcgataatttgggggttcactgaac

SEQ ID NO: 5118 - DNA, 297 bp, Zea mays
  misc_feature: Incyte ID No: 700349617H1
  unsure 153, 162, 217, 222-224, 230-232, 237, 247, 256-257, 261, 264-265, 269, 275,: a, t, c, g, or other
ggttttcaaagaaatcaatagatgcacctgagccaccatttaggttgtatggttgccatgcaaatatcgcatattcacgccctcaatcttcggatggtcttcctccattagtctcacgtcgtgtgctcgaaacgctcacgaacttggcaagangccatccanatgttgctaaactcttgctctttcttgaattcccttgcccatcaagatgtttccngaagnnngagaannnagggnctggaaaagntttttcccnnaaanagnngggnaaaaananaaaacttnganntttntttt

SEQ ID NO: 5119 - DNA, 288 bp, Zea mays
  misc_feature: Incyte ID No: 700349618H1
  unsure 213, 222, 226-227, 237, 244, 247, 255, 268, 278, 286: a, t, c, g, or other
gttggatggtataacagtggatgtctccctgcatgacccgattgcgttcagaaaggagttggatggtataacagtggatgtctcccttcaatggtcctctgattcctactctgatacagtgctaggatacgcaaacagtatccgcactattgatggtggtactcatattgatggtctaaaggcttcattgacgagaaccattaataaccttgnaaaaagttngaannctataaaggntaggganttnccctgggnggggacttttaangggggatgcnttgccccntt

SEQ ID NO: 5120 - DNA, 288 bp, Zea mays
  misc_feature: Incyte ID No: 700349619H1
  unsure 234: a, t, c, g, or other
actcgggtgtgggtgccaagcgcaatggacggcgcaaggggaagaaagggaagaagggaaagcaggatgcacctgtgactgacttcgtgccggttaagacacagattaggctggacgagaacaccgccaacaatgaggctgctggggctgcagcggagccggtgtttgttgttggtgaggctgtcaatgacagcttgccagtggttgcttctgagtctgatttcagccgtggtnaataccttatttacatggtggtggcgagagtgcaagagcatgaaccatttcctt

SEQ ID NO: 5121 - DNA, 283 bp, Zea mays
  misc_feature: Incyte ID No: 700349621H1
gcaggcgcacggcgcaccgcacacctcactgccgctcccttctcgtctcctctcctctcctctcctcggcggatccggcaccgacccaccgcccctctgctcgctccttccgccggaatcgctgctcctctctgtgctgtcgatttgtgcggcgactgttagtttggttcggtcccatccttctgttgatcaatggctgacggtgaggatatccagccacttgtgtgtgacaaggcatggaatggtcaaggctggctttgctggtgatgaagcgccagagcat

SEQ ID NO: 5122 - DNA, 280 bp, Zea mays
  misc_feature: Incyte ID No: 700349623H1
  unsure 43, 108: a, t, c, g, or other
cttcagtctgaggttgtggctgctgagaagaagcacaactttnctgtcgcagaggttaaaagtctcaggatggaattggccacgttgctggctgagaatgaggctgcngctaaggcatttgatgctgagaaggctagacttttgggcgagttggagagcctgaagaggaagttggaggaaatccaggcagacaaggaagtagctgaggtaacaacccgtgagaaggatgctcaggccattaattgagggccaattggaggagtccacattccatgtcccc

SEQ ID NO: 5123 - DNA, 279 bp, Zea mays
  misc_feature: Incyte ID No: 700349624H1
aggactctcatacctgcaccatgactgtaagcccgtgatcgtccatcgagatgtgaagtcgaacaacatcttgctcgacgcggagtatggtgccaagattgcagattttggtgttgcaaggactattggggatggcccggctaccatgtccatgattgcagggtctgtggatacattgctcctgagtatgcctacactctccatgtcactgaaaagagtgacatatatagctttggtgtggtgatcctgagctcgttaccggaaagaagccgctggcag

SEQ ID NO: 5124 - DNA, 283 bp, Zea mays
  misc_feature: Incyte ID No: 700349625H1
  unsure 247: a, t, c, g, or other
gagagatatatatggtattgatgaaaagagggttgctagcttggtaagggaggataaagtggacatacttgtggaacttactggtcacacagcaaataataagttagggacaatggcatgccgacctgctcctattcaggttacctggattggctaccccaacacaacaggtttgccaacaatagactaccgaatctcagactcattgactgatccacctatgacaaaacaaaagcatgttgaggantggtgcgcttccctgaaagctttctttgttaatacc

SEQ ID NO: 5125 - DNA, 280 bp, Zea mays
  misc_feature: Incyte ID No: 700349626H1
  unsure 245, 276: a, t, c, g, or other
acggatcgtaagcatgaggctgttgtgaacgaattctattccagagtgttaaacaatggcgacatatatagagctgattatgaaggactttattgtgtgagctgtgaagagtacaaggatgaaaaagagctattggagaacaattgttgccctgtgcatctgaagccttgtgttgaaagaaaagaagataactatttcttgcctgtcaaagtaccaacataaattggaagagctactgacaagantcccgattttgtaaggcccatcatatcgccngagg

SEQ ID NO: 5126 - DNA, 230 bp, Zea mays
  misc_feature: Incyte ID No: 700349627H1
  unsure 83, 178, 203, 221: a, t, c, g, or other
aacaaggatatcttcctgagggagctcatatctaatgcctctgatgcgttggataagattaggttcctttctcttactgatanggaagttctaggtgaaggggacactgcaaagcttgagattcagattaagttggacaaagagaagaaaatcctctccattcgggataggggtattngtatgaccaaggaagatcttttaangaaccttggaagattgcnaattctggc

SEQ ID NO: 5127 - DNA, 150 bp, Zea mays
  misc_feature: Incyte ID No: 700349628H1
attagaactagttattattggttcatgttgaacttatatatatttccatccttttgcagttagtttgagtcatatttgctgtgtaccaaacatgtattgcaaatttggaatttttgtaagctataataaggccagcacggcaatatcccc

SEQ ID NO: 5128 - DNA, 107 bp, Zea mays
  misc_feature: Incyte ID No: 700349629H1
  unsure 26, 56, 58, 71, 76, 79-80, 86, 88-89, 101: a, t, c, g, or other
gtgtacaatgcgatgctccgtaggancaacgggcactggagcaaagattagctganangctggctgcagtncagcngtnnagaggncnngcacatcactgnatgccc

SEQ ID NO: 5129 - DNA, 282 bp, Zea mays
  misc_feature: Incyte ID No: 700349630H1
  unsure 242: a, t, c, g, or other
gccaaccggcttagattgccgcttccccagtgcctcttcttgctgcattgctacgtcgttgttgcgattgtagcacacccgtccagcccagagcaagcatcccccaaggcgaaccaacatcctctatcatacaacaacctacgaccagaagattttccaaacgatcggctctaccgcgcttaccacgccattcaaagcttcaagagcacgatcacttcggatcccaagaacatcaccggcantgggccggcaacgacatctgcggcgagaagagctacgtcg

SEQ ID NO: 5130 - DNA, 283 bp, Zea mays
  misc_feature: Incyte ID No: 700349631H1
ccgagtcatgactgtttcctttcacaagtatggggattttttccctggtactggacatatcactgacgttggggcagccgaagggaagcattatgctctgaatgttcccctgagtgatggtatcgatgacaccacctttcgtggtctgtttcaatgcatcattaagaaagttatggaggtttatcagccagacgtggttgtcctccaatgcggactgactctttggctggagacaggttaggttgcttcaacctgtctgtgaagggtcatgctgactgcctcg

SEQ ID NO: 5131 - DNA, 279 bp, Zea mays
  misc_feature: Incyte ID No: 700349632H1
  unsure 268: a, t, c, g, or other
cagatcacttctgtcttgtgaaaatggcggatgaactatgctcaatgtctgtgggtcagaagttccatgggcagtccgtgctgttgagcagaatttcttcctattctgccatgaacaaccctgtattcaacaatgcctattctgcttacaatgtgccccagaggtcatatcatgggatgaatgcaactgctggactctcatctgtcatggcaccatctcctgtcttgctctgccccaaaagagaaaggctttctggattatgatcganttatgatgggt

SEQ ID NO: 5132 - DNA, 184 bp, Zea mays
  misc_feature: Incyte ID No: 700349634H1
  unsure 36, 60, 68, 133, 167, 181: a, t, c, g, or other
gacgattcagtgaggcacccctctcctggcctcttntcgccttctccgtttccgcgaacncagctgcntcgtagccccaccacaccgccgagcacgcggtctcccgcgccgccttccacccaagcgaagtacnccctactcgacccagaattatcttctaccagcgntagtcggctcggcnttt

SEQ ID NO: 5133 - DNA, 283 bp, Zea mays
  misc_feature: Incyte ID No: 700349636H1
  unsure 45, 72, 115, 245, 263: a, t, c, g, or other
catcccctcttccctttctagccttccacccttcatccacccgcngctcctcgagcacccccgtcccgcgcngcctccggctccggcgagatgtcacgcttcggtcgatccggcncgccgccgccgatccgcgacacgtactcactcctcgtcctcaacatcaccttccgcacaactgctgatgtccctcttccctctcttcgacaagtacggcgagattgtcgacatctacatcccaagggacngccggactggtgattcgngcggattcggttcgtgagga

SEQ ID NO: 5134 - DNA, 271 bp, Zea mays
  misc_feature: Incyte ID No: 700349639H1
  unsure 39, 89, 151, 160, 174, 177, 189, 192, 196, 211, 215, 223, 250, 254, 258,: a, t, c, g, or other
cctcggtctcggataccccgagatctccgtcggcaaggntcctccgatctggcagagcatgcaggagcaggagctgctggcggaggaantcttctccttctggctgaaccggagcccggacgcggacgcagcgtccggcggcgagctcgtnttcggcggngtcgacctgcgcanttnagcgggaaccanacntacntccccgtctccggcnaggnatattggnattcgaaatgggggacttctcatcgangganatcnacgtttctgcgna

SEQ ID NO: 5135 - DNA, 276 bp, Zea mays
  misc_feature: Incyte ID No: 700349640H1
  unsure 64, 194: a, t, c, g, or other
gggcgcaatagaaaaaacaccgaacgcgccgccgctcctgccctgccccccgtatctataccancgaaggcgaggaaggggggccaaggacgagcgctttttcgtgcccgctggccattgccgctgctcacgagcctcccgccccgcgctgccctgccctctgcggctctgccccaacgagccccaggagagcnaggtaaaggagccgtcaaaagcccccgccgaggagagcacgcaaggacatggcgtcaaccgttacttcagcccattagcacc

SEQ ID NO: 5136 - DNA, 274 bp, Zea mays
  misc_feature: Incyte ID No: 700349643H1
  unsure 38, 56, 131, 263-264: a, t, c, g, or other
gatcatcctcagcaagggcaacccgcacttcgtttgcnacgctgcgcgtgctcgtnaagccctacaaggagaagggcaaggtccccgacaggttcaggaagctgcagcacccgcaccacggcgacttcgcnggctgcacgtcgcccaccggactgctggattccagggaccccttcgacctgcagcaaccgcagattggacctaggatgatgtacgggaagttgctggccacgaagcttcctgaggaggaaatggaagaagcnnagcagcggcg

SEQ ID NO: 5137 - DNA, 281 bp, Zea mays
  misc_feature: Incyte ID No: 700349644H1
aatcgacaaaccctaatgacctaatccccaacccccagccggcagccgccgagcaaaccagctcatccggtgcggtcatcccacttcatcctcatcccctgcccatcctgatccgatcggtcatctcatcctcatcccctacccgatcggatcccctgctcatccgccgagcaccaccaggcagcaggctccagtcatcgagcaccagcaggagcacggcgcgctgcccagtaggagcacggccaagaggatgacgcccgcatcctgcctcttctcctctg

SEQ ID NO: 5138 - DNA, 273 bp, Zea mays
  misc_feature: Incyte ID No: 700349645H1
  unsure 133: a, t, c, g, or other
cgaactcccttgctaggttaccacgttcttctgcccttcaggccctccctcatctgatcatctctctcactctttcagtagcagcgcagttttgttactgacacacgccccctgtcctgcctgtctgtgttgncctgatagtactagcaaagtttggagactccatccaacctcttgtctctgaaacttggacttgttgccgatcccaaggggaggttctgccaaaattcggcttctgaacatccattccagaggggatcgagggaggttctg

SEQ ID NO: 5139 - DNA, 278 bp, Zea mays
  misc_feature: Incyte ID No: 700349647H1
aaaaggtcagaaccgaaaccttaaccttattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagatccgcaggacattatc

SEQ ID NO: 5140 - DNA, 290 bp, Zea mays
  misc_feature: Incyte ID No: 700349652H1
  unsure 34, 84, 286: a, t, c, g, or other
cgcaggcagcatctgcatctctcgcccacctccnctccgcctactgctgctggtggtagggaggcggagaaggaggcccttgcncccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaatctgatctattcaacatcttcctgggcgacatgtggtccgccatgaatnggag

SEQ ID NO: 5141 - DNA, 283 bp, Zea mays
  misc_feature: Incyte ID No: 700349655H1
  unsure 98, 120, 247, 278, 280-281: a, t, c, g, or other
gaacgactgtgttggctgcaaaagtaaagtgttctgcaacaaatcagaggctgtgagcaagattgcatcgctgcaggagttcattcctcatgatttcnacgccagtgaccatgggacctncaagcttccctgtatgtgcagtgcataggattggcatcctgacattagaatcttcaacactgacaggcatgctggaaatctctggtcaagaagctggtcctgggcgccgacaatttggagagcagcnagaactcatccgttgaccaggtctctgtctncnnga

SEQ ID NO: 5142 - DNA, 232 bp, Zea mays
  misc_feature: Incyte ID No: 700349659H1
  unsure 193: a, t, c, g, or other
gagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcccggtgcgganatcgatacctgaagaatacacgctggtacgaacaggcgt

SEQ ID NO: 5143 - DNA, 273 bp, Zea mays
  misc_feature: Incyte ID No: 700349663H1
  unsure 22-23, 38, 236, 264, 266: a, t, c, g, or other
tgtggctaaatctaatctaaannggaaggtctttccanacaaccattggtaataacgtcacagtaggtcatagtgctgtgttacaaggatgcacggttgaggatgaggctttgttggcattggggcaaccctattagatggtgttgttgttgaaaagcacggaatggtggctgctggagccctcgtacgacagaatactaggatcccttgtggagaggtatggggagggaacctgnccaatttctgaggaagctcacagatgangngatcatt

SEQ ID NO: 5144 - DNA, 297 bp, Zea mays
  misc_feature: Incyte ID No: 700349664H1
  unsure 250, 266, 277: a, t, c, g, or other
ggagaggcaacaggaattagaggaagaagaaaggataaggcaactgaggaggaccgagctggttcctaaagctcaacccatgccatactttgaccgccccttcattcccaaaaggtcgactaaaccggctacagttcccatggaaccgaaattccacctcaggccagaaaagatatcctgttactgtcgacagcaatgtatggagcttggaaagctgaatccacaacagcagtgccaacatccatatggnattcgagattacaggnatcaacacacngatccaaaaatgtttcctag

SEQ ID NO: 5145 - DNA, 295 bp, Zea mays
  misc_feature: Incyte ID No: 700349665H1
  unsure 247, 249-250, 257, 286, 288-292: a, t, c, g, or other
acctgatgctgtacaagaggcttcgacttctgatatggaagatgcttcaacatctagtggtgggcagagatcatattcctgtgcaagctagtcttgacgagaagcaaaatgcttttgtgaaattctcagagaagcacagaagattgctgaatgcattcatccatcaaaaccctggattactggagaagtcattctcgctgatgttaaaaattcctcgcctgattgattttgacaacaaacgtgcatntnncgggtcnaaaatcagcatcagtatgatcatcagcancnnnnncgg

SEQ ID NO: 5146 - DNA, 288 bp, Zea mays
  misc_feature: Incyte ID No: 700349668H1
  unsure 174, 272: a, t, c, g, or other
ggcggcgcgaaggaagggagggtgagaatatcggagttcggcgatgtcgaagcggcagggaccgccgaaacaccagaaccgctacgcgtggaagccgaaccttggtcagaagataaacgaaaccgagcccgggggcaggttccgacctctgtcagaaattcaccggcgtctgcnagcgctgccgggatcaaatcgactggaaacgcagatacggaaaatacaagcccattgttgagccagcaaatgccagaagtgtaataagcgaaacgtcnggcaagcataccatag

SEQ ID NO: 5147 - DNA, 284 bp, Zea mays
  misc_feature: Incyte ID No: 700349669H1
  unsure 29, 43, 66, 96: a, t, c, g, or other
tccctcttggctcttgcagtgcaggcctntcctccgatccctnccacggtctcaccccaccgcctncgaccacacagctagcttaattagcttgcncctcctcacgctctcctcgcccgaatggggttcacggcgagctataggcggagtagctggccaatgtgcggcggcgacagaggaaaggtgcggctgcggctcgatggaaggcagcacacgcacaggtaggagaagggcgggcgtgcgaccgagcgtgcaccattggctcccatgctgtcggctggaat

SEQ ID NO: 5148 - DNA, 280 bp, Zea mays
  misc_feature: Incyte ID No: 700349671H1
  unsure 32, 224, 235, 241, 246, 260: a, t, c, g, or other
atctttccccaccattgtatgttacaattttntaactacatctgttatgtttgggtgctcttgcattctcgcaaagtgctatagaggagcaacggtaccaggacgcgtcaaggttgacaaagctatctgggaccacttttgtaattgccaactcttcactgattattttcctatatgttgctccagaataaatggatcatagtgcggtggtcagggttgggatntgctccgtatnaggggnaagcncccggtctccctcnaggggaaagtcaactgacct

SEQ ID NO: 5149 - DNA, 280 bp, Zea mays
  misc_feature: Incyte ID No: 700349678H1
  unsure 115, 180, 220, 222, 231, 247, 249, 253, 271, 275: a, t, c, g, or other
agacaatgctgtagctaaaagaaactaacagtcaagcatgacccagggatggttcatgctgatactagtcaaattggacaacaatgacagctaaataactgactagcatgccagnccacatgtcattagtagaatcccaactgtacctagcttaggtatggcatctcttgttgaagatgnaccattagcaaaacctacccttctatattcccgtgttacnangtccaatgnatttgatatatggccngnggantattgtgtaacaatcatntttncttgg

SEQ ID NO: 5150 - DNA, 278 bp, Zea mays
  misc_feature: Incyte ID No: 700349682H1
  unsure 251, 258, 261, 267, 270, 273: a, t, c, g, or other
cctctcccagaggaacaactgaacagcatggataagatatttgaaggcaccacaaacttgtctaacggaatttcgtttcgagctcctggaaaaaatggatcatatgccgccatggacaatgtggatacagtaccaactaattcaccttcacagaaaaacgctggcactcctagcaatgacatagaaagcaagacccacccatctccggcaatttgaccggaccagagcaagtattcgactttgaaagatcncccgttnacnagtganttnacnggggg

SEQ ID NO: 5151 - DNA, 279 bp, Zea mays
  misc_feature: Incyte ID No: 700349683H1
  unsure 14, 30: a, t, c, g, or other
gagcgacacgggcngcggtcaccgcgcgtntgccgaggccatcaaggctgccttcacccaggagttcggcgacgactaccaggtatttgtcactgatctgtggactgaccacactccatggccattcaatcaactgcctaggagctatagttttttggtgaaacatggacccttgtggaagatgacatactatggtactgcaccgcgtgtagtccatcagcctcattttgctgcaacatccacttcatagcaagagaatggcaaaaggtctaatgaatc

SEQ ID NO: 5152 - DNA, 278 bp, Zea mays
  misc_feature: Incyte ID No: 700349684H1
  unsure 171: a, t, c, g, or other
gataaagagccctctctttatctgcatttccacctgttatcccttaccatcctttgcctgctggtgtttcggatgaaccaaaatatctaggcagagacaccaagcctgttgggcactatctatattcaagtggttttcgtacatcggatgacacgattccttctgacagcnatgcaagttatggcggctcccaggcacctggaagaggatatggggcttacagcgggtacagtgctcgctcctctaatagtgggttatctggtcatagttccttcaca

SEQ ID NO: 5153 - DNA, 183 bp, Zea mays
  misc_feature: Incyte ID No: 700349686H1
atgtaggctacctgctacatcatgctcgattcactatcctttaattcggtcatcgtcgtcgtcttgtctcgtgtcaaataaagctctcttgtgcctatatacggctctcatggttgtgccgtgtctctatatgttagtgtttatgtatatgtggagatcaaataatggcctgcaataatgatc

SEQ ID NO: 5154 - DNA, 275 bp, Zea mays
  misc_feature: Incyte ID No: 700349687H1
  unsure 238, 241, 253, 256-257, 261-262, 271: a, t, c, g, or other
ctccgatcccaactgccatggcgctctccatctacacgcccacctcctcctccctcgtcccgccctccattcaggaggtcaggttgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtggagaacangtnttcgagtttaanggnngacnnggggccacnttgg

SEQ ID NO: 5155 - DNA, 274 bp, Zea mays
  misc_feature: Incyte ID No: 700349688H1
  unsure 273: a, t, c, g, or other
gtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctatttcagaaagcttttattggtctgactgctggtgcaatggtgctgtgttggtagtcctgctgatcgggacataana

SEQ ID NO: 5156 - DNA, 281 bp, Zea mays
  misc_feature: Incyte ID No: 700349691H1
  unsure 50, 58, 60-83, 120, 164, 168, 173, 185, 188, 195, 211, 215-216, 234, 239,: a, t, c, g, or other
ggccgacccatggtggaagggatggtattggccgtgccgaatggggtganggcggatngnnnnnnnnnnnnnnnnnnnnnnnntaaggcagattctcctaaatccgttctggaggacganaaaatttctgaatccaagaatgggaacgcctcttagccacgganccantaaancaaggggacganacntcggacnattttgtggatgcaangaanncccttcctgttgaccatnaaaancgncagtgccaatnntgcccccatgctgtngagncagnaang

SEQ ID NO: 5157 - DNA, 276 bp, Zea mays
  misc_feature: Incyte ID No: 700349692H1
  unsure 272: a, t, c, g, or other
cacatccaaggaaggcagcaggcgcgcaaattacccaatcccgtgctacgcgtcctgcgtgagttggctgcggcgccgtcctcgtcagcggcaacgagctccgactcgccctccaggcgggattcgaccccgccaggtgtatatttaacggaaatgggaagacactcgaagatcttaaattagctgctgagagtggagtatttgtaaatgtggatagcgatttgtttggagaaattgtcagagtgcaagagctgactggaaagaaagtgccntttt

SEQ ID NO: 5158 - DNA, 289 bp, Zea mays
  misc_feature: Incyte ID No: 700349695H1
  unsure 112, 144, 195, 204, 208, 210, 241, 259, 266-267: a, t, c, g, or other
ctccgctgctgacactgcgaagtgcgaatcaaagccaccaccgcgcacaaaccatggcaccggtggaggcggagagcaccggcggagggcgttggcgctcgcggcgcacgangcctccggcgccgtctcccccatccgcatctncgcgaagggacactggagatgacgatgttgccatacagatactgtactgcnggatatgcnactntnatctgcacaccatcaagatcgagtggaagancgccaactacctgttgtncctgggnnacgaaatcgccgggtgatcacg

SEQ ID NO: 5159 - DNA, 177 bp, Zea mays
  misc_feature: Incyte ID No: 700349701H1
  unsure 7, 78, 158, 176: a, t, c, g, or other
gactgcnacccctcctcttccttgtgatctccgaatacccatctcagattccaagggccgcgccgtgtaatccccggntctccccacccaccatatatctagtatccgcgcctcaaatccctcgcgaaacgccccgccgtaagcagttgttgtctgcngtgatttgagccgggggng

SEQ ID NO: 5160 - DNA, 303 bp, Zea mays
  misc_feature: Incyte ID No: 700349703H1
  unsure 225, 233, 256, 269, 272, 287, 301: a, t, c, g, or other
gccctctccgccatggacgcacagcgagccctccttgacgagctcatgggcacagctcgcaacctaacggaggaggagaagaaggggcacaaagagctgaagtgggacgatccggacgtgtgcggcccttacatggttcggttctgtcctcacgaccttttcgtcaacaccaagagcaatatcgggccgtgctcgaggatccacgatccgaagctcaaggaaagnttgagaantctcctaggcagatacttatatncaaggtttgaggnagntttcaaaaatttggnaaatttggaaaggnct

SEQ ID NO: 5161 - DNA, 303 bp, Zea mays
  misc_feature: Incyte ID No: 700349704H1
  unsure 273: a, t, c, g, or other
agaaaagggttagatcccgattctctcataggaaacttttatttatttcgccttcgttggatgatatacaacggttggtggagaatttgcttatactggccaaagactcaggtttaccatcaaagtatatcgccgattataactcaagacttactgtatcctttctacgacctgactgttatggtgcatatctcatcttatttgagtacttagcattaatggcatatatcttgttaaatgaacaaatgttgcttcggaactaaaactggtacnctaactggctaaactcatccttcaatcccg

SEQ ID NO: 5162 - DNA, 311 bp, Zea mays
  misc_feature: Incyte ID No: 700349705H1
  unsure 289, 297, 306, 308: a, t, c, g, or other
gtggtacttcccacacctaaagcttgacaaactcatatgtacctatccttggaacaattccgaactgacagagacagaaaaaatggatcgtttgggattagttgatttcttgaagggtctccttgaatttgatccaaataagagatggtcaccattgcaggctctataccatccattcataacaggcaaatcgttcaccggtccatatgaacctgtacctgagaccacaagaattcctgttgttcgtgctgcagcaattgatcacaatcctggagggggccatggctanattcagtnttccccggngnggg

SEQ ID NO: 5163 - DNA, 304 bp, Zea mays
  misc_feature: Incyte ID No: 700349706H1
  unsure 12, 60, 79, 129, 132, 138, 144, 147, 168, 171, 196, 215, 228, 233-234, 236,: a, t, c, g, or other
agactctttttnaccttttcccggatagctttggtagcaggttgcatgaaagaagcaaanaaagtccgaaaacaatganacatctaaataaacttttcccaaacaaaattttgatccagcttccacacnatncaccanaactanagnttggaagcagcagttggctcntgntgttgtcacccttagagccggtcanatattggtagcattcgcangttcctgagtccnaatgnntnanaatagatgatnggnccaatattcntcnnggnccancaggnggtangaggtgngcncaacgagttgg

SEQ ID NO: 5164 - DNA, 317 bp, Zea mays
  misc_feature: Incyte ID No: 700349707H1
  unsure 3, 7, 9, 12-13, 18-21, 24, 31-32, 37, 48, 56, 77-78, 84, 88, 91, 106, 109,: a, t, c, g, or other
gcngaanangcnnaagtnnnnaangcggcanngccangcgccggcaanagctttancaggacagaattacgaagctnnctgcantccntancggacgtttcagtgncgnagttttnaggaatagggggagggaatattctcagttttggctgcaattgtatcgggttttgtttatttgttagcgttcgtcaacgagnntacgacacacatttttgccaacgcaagaattcgcgtttatctactcganatcaaccaacgtgttattactagaangnnaaanaanggggggccgccgactgggnaagttgtnganccgg

SEQ ID NO: 5165 - DNA, 172 bp, Zea mays
  misc_feature: Incyte ID No: 700349709H1
gcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgacc

SEQ ID NO: 5166 - DNA, 173 bp, Zea mays
  misc_feature: Incyte ID No: 700349711H1
  unsure 4, 8, 14, 52, 56, 59, 62, 74, 93, 106: a, t, c, g, or other
aganaganagaganagtgcgtgcgaatgcggagttactcggggactggtacnagcngancangggtgggcggtnggggaagcgagtggaagantgggagccaagancacggagagtgccccgggatcttcacctcccatcattcgagtgtggagtttgtcctacttccgggag

SEQ ID NO: 5167 - DNA, 176 bp, Zea mays
  misc_feature: Incyte ID No: 700349712H1
  unsure 81: a, t, c, g, or other
cagtaagcaagcagcggagacgccggagagcggtgaagaagcatggagatggagcagctctgctcgctgctccgcgacctncgacgcgctcaagcagcatcccgacgacctcacttccaccatcgatcggatgcgggagcggctagtgacgatgatgaacccgacagccggtgccg

SEQ ID NO: 5168 - DNA, 177 bp, Zea mays
  misc_feature: Incyte ID No: 700349714H1
  unsure 124: a, t, c, g, or other
ccgagagtcactggaagaagctcgtccggcgccccgcgacgagacgacggcctcctcctccgctccgctgaagaacgacctccccgctgacagaggcggaggctccgcagaggcgcagagagangtggcgtctgccttgctgcgctgcgggtctgcggtctcctgcagattcccgca

SEQ ID NO: 5169 - DNA, 324 bp, Zea mays
  misc_feature: Incyte ID No: 700349715H1
  unsure 9, 202, 207-208, 217, 219, 233, 246, 249-250, 254, 300: a, t, c, g, or other
ctgccgagntgttggggcgggcaaacaagacgcagctggagatcctggtggccatcaaaaccggcatggccacttttgtcactggtaagggccgagtctccagcagcgagcttgtggagatgtttctgatgacacggtgccgcaacctgaactgcaagagtgccgtccctgtggacgactgcgagtgcaagatttgctccancaaanngggttttcnanggccctgtaagtgncccggtttgccanaannttgnattgtgctgcgaatacatgcagctgggttggatgtgaagtctgctncccattggtgccagctgcatgcgg

SEQ ID NO: 5170 - DNA, 316 bp, Zea mays
  misc_feature: Incyte ID No: 700349716H1
  unsure 32, 50, 150, 244, 283, 288, 300: a, t, c, g, or other
gctccggctgcgctctgccttgctttcctgcnacctgctctagcgcgagnaggagaggtacggcggccgatctggcggcgcaggcggagggctcggccggggccggcaagtcggcgccgaacatggggaggggccgggtcgagctcaagnggatcgagaacaagatcaaccgccaggtcaccttcgccaagcgccgcaacggcctgcttcaagaaggcgtacgagtctcggtgcttgcgacgcngaggttcgcgttcatcatcctcttccaaccgcggcaagntctangagttctccatnagcagagatgccaaaa

SEQ ID NO: 5171 - DNA, 170 bp, Zea mays
  misc_feature: Incyte ID No: 700349718H1
atgaggagctttgagatttaagaaccgaaagtaaacactgccaaccactcttccgtcttcaaccctttggcaaccagcaaacaaataccagtaccgctccactacttgattgccgcctcactggcaccgctggtccgctcccagttccagtgacactgcaccagaccacc

SEQ ID NO: 5172 - DNA, 303 bp, Zea mays
  misc_feature: Incyte ID No: 700349720H1
  unsure 222, 241, 259, 280, 290, 297: a, t, c, g, or other
ccggagtccggagcatagcaacctcgctgggctcccatatagcgggcccgcggagccgggatatactccagggaagtcgagcaaggagagcgtggattgtggactacaggggtaaagatcgagtgagcatcgcttcaccatgcgcccttctctctgctgcgcacctctttttcttctgctactattacatttggcatttgctagacctctctttcctctacngataagacaaagatgaggngagaagcccatacagagnttcgggccatataacattgcncatcgggatnaatgggnattccg

SEQ ID NO: 5173 - DNA, 166 bp, Zea mays
  misc_feature: Incyte ID No: 700349725H1
  unsure 27, 68, 105: a, t, c, g, or other
ggacgacttgccccccatctcccagtntcgccccgtcgaaacgagcacactacatgcgacggaaaacntgctcccctcccccctggtgtcgtgcctcccagcganagggattggctcggctcgcgcgctccgctccgcacacgctagatccgcgatcgcttggggt

SEQ ID NO: 5174 - DNA, 168 bp, Zea mays
  misc_feature: Incyte ID No: 700349727H1
ctggagagacaggacctatggtcaatgaagaagatatccagcacatagtatcttcatggactggcatccctgtggagaaggtttccagcgatgaatctgataagcttcttaagatggaagagactttgcacaagcgtgtcattggccaagatgaggctgtggtagcaa

SEQ ID NO: 5175 - DNA, 168 bp, Zea mays
  misc_feature: Incyte ID No: 700349728H1
atctgaggaccatgactccaagtgcttttgagtcagcacttcgtcaaaaggatggagagcttgcttcttacatgtctcgcttggcctcattggaatctattcggaattcactggcagaggagttggtgaaactgacagaacaatgtgaaaagttacggactgaagccg

SEQ ID NO: 5176 - DNA, 155 bp, Zea mays
  misc_feature: Incyte ID No: 700349729H1
gccaagggggatcggtcttgttctcggagagggttgagctgcttgacggttttgactcggatcatggtgtgcagctctatcagatagagagctgacgtgaggtgtgagacgcggatcgtggagtactactcagtaggagaggtggggagggggaa

SEQ ID NO: 5177 - DNA, 157 bp, Zea mays
  misc_feature: Incyte ID No: 700349730H1
gaagttcttcctccaagtaatactcctggggtggccattctggacatgtgcagcagctgggtcagccattatcctcccggttacagacaagagaagatcgtggggatgggtatgaatgaagatgaactgaaaaagaactcggtactgactcagtatg

SEQ ID NO: 5178 - DNA, 312 bp, Zea mays
  misc_feature: Incyte ID No: 700349731H1
  unsure 241, 245, 249: a, t, c, g, or other
aaattggcagtggttttgatgttagtgctgctgtctatgggagtcaacgctatgtaaggttttctccagaaatactctcgtctcaggctacaggtgggactttcctcccagatgtagtatcagatattgttacacaaaggtgggatcatgagaataaacagttctcattacctcctctgatgacccttctccttggggaacctggaaccggaggatcatctactccatcaatggttggatntgtnaacngtgggcagaagtctgaccctgagaaatgcaaagatacatggagtaaactggctttgccattca

SEQ ID NO: 5179 - DNA, 317 bp, Zea mays
  misc_feature: Incyte ID No: 700349732H1
cgaagagaagctgaggcctagcgccgcacccgccgccgcatcagccatcagccatggcgatggccgcttcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcatattgatccagatgacccagcggcaatttctcatatgctccag

SEQ ID NO: 5180 - DNA, 137 bp, Zea mays
  misc_feature: Incyte ID No: 700349733H1
  unsure 2: a, t, c, g, or other
gnccagcgtgctgtcctcaattcgctcagtacactggcgccccatgccatcgctgggaggcacacccctggtacattcactaatcagctccagacctcttcagcgagcctcgactgttatcttactgacccaaggat

SEQ ID NO: 5181 - DNA, 304 bp, Zea mays
  misc_feature: Incyte ID No: 700349734H1
  unsure 215, 218, 222, 260, 268, 272, 276, 285, 295: a, t, c, g, or other
aagaagctgacacattgatactcattgtagggacaacaccccagtgcccgtgtccttgatcagtctgttgtgtttgcgaagtgtgaataagatataggactgtttgattcccggtacagcgcagggtttcagcagaaagggctggatggatgatgttttgtggcgatgctgcctcgttgagtctttaaaacgggtgtaactcttcttcttttgtnagncgtnatgatgtatgaaccgtgtactgatttgtaaaccttgcntgggaagnaaanaaantggttccangggggggganccccccggg

SEQ ID NO: 5182 - DNA, 306 bp, Zea mays
  misc_feature: Incyte ID No: 700349735H1
  unsure 55-56, 196, 208, 236, 266, 270, 276: a, t, c, g, or other
aaactcaccacctcccaatggagaacggcgacgaaaccctcgcctcccccacggnngccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaggagggcgntgcccacaccancgcgaagtcctacgcagctgtcgccgcncaagccgagatcgaggacttccgcgccgcnaagntcgacntggagaagaagttcgttgaggcccgccgtg

SEQ ID NO: 5183 - DNA, 300 bp, Zea mays
  misc_feature: Incyte ID No: 700349736H1
aatcgcgtgatgttgtctcttggtccgcggtgatatcaagccacgcgcaccatggctgtgcaagggatgctttatgcgttttcaatgaaatgctggatgcgaaggtggcaccgcctaacgagatcacttttctcagcatccttactgcatgtagtcatggaggattggttgatgagggactcaggtattatggaattatgaatgatgaatatggattgagcccaaccataaagcattgcacctgtgttgttgatcttcttggacgagccgggaggttagccgatgctgaggcttcataag

SEQ ID NO: 5184 - DNA, 300 bp, Zea mays
  misc_feature: Incyte ID No: 700349738H1
ccacctccccgctcgctctcctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatcctatgccaagtctctgtcacaaggttcctagcacgggaaaatgccacgcttctatgacaacaagttacatggaaacatcagatgtcatgatttggactgggaaaacttgg

SEQ ID NO: 5185 - DNA, 298 bp, Zea mays
  misc_feature: Incyte ID No: 700349739H1
ggtgatgagaagtatcttgggatggttaacatgattggtacccacttcgaggaaaaccatgtcgctactggatttggaaatcatatggcaatcccgatactccgtgctgaatggcgcgatgatatgacttttgaagaagctgttaagctggttgagaagtgcttggtggtcttgctgtaccgagacagatcatctatcaacaaattccagattgccaagatcacaagtgaaggatcaaccatctacccaccatattccttgaagacctactggggcttcactcattcgaaaacccagc

SEQ ID NO: 5186 - DNA, 292 bp, Zea mays
  misc_feature: Incyte ID No: 700349740H1
  unsure 277, 287: a, t, c, g, or other
gttaagagccttaaaaatggcatcgtggttaatattcttgggatgggcgctgctgttctcggcatgcaagctactgttggtgctttggtagcaaaagctctcacaacctctgcagtaccctattatcaggctgctggccaaagccctgtcttggctttagatgttttcctagttcaggcttcagcgaacaccatcctgtcgcatttccttggggtggcgagctccctggagtgctgcgctcggtgtcatgctccagcagaagccgcgtcccggcccnggccctgaanggctt

SEQ ID NO: 5187 - DNA, 165 bp, Zea mays
  misc_feature: Incyte ID No: 700349742H1
  unsure 26, 41-42, 60, 62, 106, 124, 133, 156: a, t, c, g, or other
ctttggccaccggatagctaggaacnggcgatcgccagganngaacgacgatgcaggggncnctacggctacgacggggcggcgtcacgggaccccaagccgcggntgcgctggacgccggacntccaccagngcttcgtcgacgccgtcaccaanctgggcggg

SEQ ID NO: 5188 - DNA, 185 bp, Zea mays
  misc_feature: Incyte ID No: 700349744H1
  unsure 162, 182, 184: a, t, c, g, or other
gcgaaaaaggataggaatcctcttgtgtcctggccgtcggccgtcgctgcgtcgttccagatttggggaaggaaatccggcaccgagattcgagtcgaaaaggacatcatttgctagatggcgcgtaccaagcagaccgctcgcaagtccactggaggaaangctcctaggaagaaattcgnana

SEQ ID NO: 5189 - DNA, 300 bp, Zea mays
  misc_feature: Incyte ID No: 700349747H1
  unsure 241, 248, 268, 291, 296: a, t, c, g, or other
ctcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgcacctgnaaaaatnggtccccctttccaggaaanggggcctcaaataaagtgcggtntttcnccca

SEQ ID NO: 5190 - DNA, 227 bp, Zea mays
  misc_feature: Incyte ID No: 700349749H1
  unsure 146, 212: a, t, c, g, or other
tccaactctcgtggcgccccagggcgttcctgcacaagggtttcctgtcggatgcggagtgcgaccacctcatcgcgctggccaaggacaagctggagaagtctatggtggccactaacgagtccggtaagagtgtccagagtgangtgcgcaccagtccggcatgttcctcgagaggaagcaggatgaagtagtaacgagaatagaggagnggattctgcttggac

SEQ ID NO: 5191 - DNA, 148 bp, Zea mays
  misc_feature: Incyte ID No: 700349750H1
  unsure 6, 47, 63, 67, 73, 104, 116, 132, 145: a, t, c, g, or other
caagtnttctcttgggcagcagttgtgatctacgaactctttctgcngacttgaccaacatcncttntggtcntgtcaatcttgcaacactcccttctaaaganttgtctagaggntggattgccctgctcnctgctggcgcagnaac

SEQ ID NO: 5192 - DNA, 198 bp, Zea mays
  misc_feature: Incyte ID No: 700349751H1
  unsure 173, 197: a, t, c, g, or other
gtgactcaggatgtaagagccgcagccaatgggatagctgtaacactaatgtccatctctaaagcggttgctccagctgttgcaggaatcatattttcgtgggcccagaggcgtcaaacagctgcatttcttccaggcgaccacttggtgttcttcatactgaacatcttcangttcatcggtttcgtcttcacctnc

SEQ ID NO: 5193 - DNA, 297 bp, Zea mays
  misc_feature: Incyte ID No: 700349752H1
  unsure 222, 230-231, 233, 235-237, 241, 244-245, 248, 254, 294: a, t, c, g, or other
gatctctctctgtgggagcggttctatttgcaaggcatagattcactgatgaccctgtacgagctggattactggcctccccaagacaaggaagtgaatcagcgtacctgacactgcccgccgtgggactgctccagggctgcgttggactcaggaagctcttcgtccatggcaccacacacgagcatttcctgacctttttcttgaaggtgccgaatctgngggacatnnantnnngggnggnntantatccngcccaagagagtgatgtgttaaacgggaaatgcgagctgnttt

SEQ ID NO: 5194 - DNA, 300 bp, Zea mays
  misc_feature: Incyte ID No: 700349753H1
  unsure 14, 78, 226, 263, 280, 297-298: a, t, c, g, or other
agcttgtgcttgtnagcgcccataacaacgagatcatgccgggacgtggcaaagggtgaaaattctagcgtgcaagangtgctagtgactgatgtcagtcaagacttggagaagcaggtagtgtggggctgatacgtccaataatgcgctagtgactgatgtcagtcaagacttggagaagcaggcagtgtggggttgatacatccaatgatgctgagagggtgantgaacagcgagcggtcatgatggcacaagctacctcncccttattatctggtgnttttggattcaagctgnnag

SEQ ID NO: 5195 - DNA, 300 bp, Zea mays
  misc_feature: Incyte ID No: 700349755H1
  unsure 3, 30, 78, 86, 129, 135, 138, 217, 221, 237, 247-248, 263-264, 270, 279,: a, t, c, g, or other
gcnacgtcaacaacagttccaggggctgtngtcccagcagagcagtggacacaggatgaacatgaactccaaaaagcngagaaganagcagtccaatagggagtctgcacgtagatctaggttacgtanacaggntgnatgtgaggcttggctcaacgtgctgatgttttaaagcaggaaaatgcttcacttagagatgaagtaaaccgtatcaganaagngtacgaggaacttctntcaaggagtnnctcactaggggaaanncttggnggcaaaccngcacaactctnttggggcngg

SEQ ID NO: 5196 - DNA, 302 bp, Zea mays
  misc_feature: Incyte ID No: 700349757H1
  unsure 179: a, t, c, g, or other
ctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcangtacgggaccgcgaagagcggcgtcggcgtggcgtcgatgggtgtgatgcggccggagcttcgtcatgaagtccatcgtgcccgtggtcatggctggtgtgctcggtatctacgggctcatca

SEQ ID NO: 5197 - DNA, 302 bp, Zea mays
  misc_feature: Incyte ID No: 700349758H1
  unsure 194: a, t, c, g, or other
taccggcgcggcatgtccacctacttcgagatggtggcgcaggggcagggcaagaccatgagcgtgtgcctagcgcgccgccccgacacggcgtccagccccttcatctccgcgctcgaggtcatcgacctcgccgactccatgtacaacaccacggacttcagcaggttcaccatgaccaccgtggtgcgcancgcttcggcagcaagggcgatatcgtcagatgacccgtacaaccggtactgggcgccgttcgcggacgccaaccccatggtggagagccactcctccatctcgcccga

SEQ ID NO: 5198 - DNA, 304 bp, Zea mays
  misc_feature: Incyte ID No: 700349759H1
  unsure 125, 141: a, t, c, g, or other
accagcttacgggatgagtttttgcagcattttcttcgtgaggaacctgttgttgggattgaatatgaagcacagttacaaaagactcttcttccccatatttcttctgcggaagtggcaaaatnctgcagaaaacttttncaacggccagcagctgtgttatcaagatagttgaacctcgagctcatgcttctttggaggatctgaaagcagttgtgttgaaagtgcaacagtatggaagaagataaatctatttttccatgggatgaagaacaaattccagaagaaattgttgcccaagctc

SEQ ID NO: 5199 - DNA, 304 bp, Zea mays
  misc_feature: Incyte ID No: 700349760H1
gctgaagccaaacttcctcggcacaaagttcacaatatttgacagccagcctcctcccgacgctgtagcgctgccaaacaacagaccgagcaaaaggcagtcgaagcaagtgtcaccgagactgccactaggcaactacaacgtcgccacggtcacgtatgagctcaccgtcctgcgcaacagggggccaaggagaatgcagtgcaccatgcactcgataccagccgagtgcatccaggagggcgggaaggccccaacccctaccggtaccgtccagccgttgacgagccagtgcccaccttac

SEQ ID NO: 5200 - DNA, 302 bp, Zea mays
  misc_feature: Incyte ID No: 700349762H1
  unsure 120, 294: a, t, c, g, or other
tcccgatcagcaattcctacctctccctaagagagctagaagtatcctggtagctggaagtcatgctagcaatttggggtaccagtgtggtggatggtcaatccaatggatgggggacantggtaatatcacaactgggacaacaattcttgatgcgataaagtctaccgttgctgactcgacgtctgttgtctactctgagaaccccgatgacagtttcatgaagcacaatgacttctcattcgctatcgtcgttgttggcgagccaccatacgctgaaacagttggcgatanaccgacct

SEQ ID NO: 5201 - DNA, 306 bp, Zea mays
  misc_feature: Incyte ID No: 700349763H1
  unsure 13, 16, 53, 118, 144, 146, 148, 157, 172, 269, 272, 284, 297, 302: a, t, c, g, or other
cccattagtgacnccnaccagtactaaacttttgaaccttttagtattggatngtggcaaaacccagtggaggagggtgaaagaaccttaaaattctaattcttaaaataaggcctcnaattttttctagtcaaaacacatgcnananagtaatctntttagatgtgcaacnatggttgttaggtgtgtttctatctctaccataaaagagttatgcaacttacattccaaatctatgctagcctagcaagctaaactaggagtaaggnctncacctagtaaancataagtaagtgnggggncctg

SEQ ID NO: 5202 - DNA, 309 bp, Zea mays
  misc_feature: Incyte ID No: 700349764H1
  unsure 104: a, t, c, g, or other
agaaattggtcagcttgtgccttggcacccttggtcagcatcttgaagatatcatcactgatatttcagaatttgctgccttatttccaccccacataaagttnacaattatgtctattgcaaggaggaggaggctcctgaatgatgaagttttgacttctcttgctgaaagttcctgggaaatcctagatatatctggatctgatgtaactgatgctggtttggctactgtagcgaatgtttgtagtaatttacgagcagttgatattagtcgctgtgaaaaagttactacttctggtgtgtctgaga

SEQ ID NO: 5203 - DNA, 304 bp, Zea mays
  misc_feature: Incyte ID No: 700349765H1
  unsure 34, 45-47, 64, 74, 107, 109, 114, 277, 287, 289-291, 301: a, t, c, g, or other
tgtcgttgttgaaaagcatgggatggtagctgcnatgccaacaannncctcatcctcaaccgtncatccttgtnacacagcactgtgacctcttgtgcatgtggcancnccctnatctaagtgggaaagtctttccaacaatcattggtaataacgtcacaataggtcacagtgctgtgttacaaggatgcacggttgaggatgaggcttttgttggcatgggggcaaccctattagatggtgtcgttgttgaaaagcatgggatggtactgcaggntccttgtaanannnaatactcggntcc

SEQ ID NO: 5204 - DNA, 289 bp, Zea mays
  misc_feature: Incyte ID No: 700349768H1
  unsure 6, 260, 268, 270, 286-287: a, t, c, g, or other
ccgttngcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgtcggggagggcctccctgccgtcctcaatcactccctcgcctccgccttcgacttcatcctcgcccctctggttgatcccaactaccggccggcgcccggcgcgttntgcaagtntnaggtcacacctcgtcnngg

SEQ ID NO: 5205 - DNA, 291 bp, Zea mays
  misc_feature: Incyte ID No: 700349770H1
  unsure 229, 262-263, 273-274, 284, 288: a, t, c, g, or other
ttacagaagaacatctacactttgacggagcaatcacaacgagacaaggcggagatgcaggatgagttgaaggcaatacaagaagataaggatgcagtgctaacacaactgaagcagtcagagacttcagtacaaaatctagaggatgagttgacacgactgaaagaggagctttccgtccagctagaaaacaattccaccttggacaagcagtttgcagaagccaggngcaatctgcatgctgaaatttcagacctactanngagagggccnnttctctgggntttnggg

SEQ ID NO: 5206 - DNA, 291 bp, Zea mays
  misc_feature: Incyte ID No: 700349771H1
  unsure 236-237, 258, 260, 266, 271, 276, 279, 281, 284: a, t, c, g, or other
tagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcaagagaagtaaaatgataagacgtgttgtagcctgcaaggacgcggcaaatttatcttgtttgagtgagcanntacgtcaacatcgtccactgnantctccnaaccngaatnttncnccncccccaa

SEQ ID NO: 5207 - DNA, 296 bp, Zea mays
  misc_feature: Incyte ID No: 700349773H1
  unsure 292: a, t, c, g, or other
gtggatcatcctgtcggcgtgcgccgtggtgcagctccccgtgtacctgttcacggagccgctgctggtggcgctggggcaggacccggacatctcggcggtggcggggaccgtggcgctctggtacatccccgtgctcttctccttcgtctgggccttcccgctgcagatgtacctgcaggcgcagatcaagaacatgatcatcacgtacctcgccatgctcaacctcggcctccacctcgccctgtcctggctcgcggccgtccacctccgcctcggcctcgccggcgtnatgg

SEQ ID NO: 5208 - DNA, 297 bp, Zea mays
  misc_feature: Incyte ID No: 700349774H1
cctctctcctgtgggcgctccctctcccccgcccccaaatcatcgcgcctccctcgccacgcctcacagggccggttgcgtaggagaaaggagaaaggaaggaggggaggcggtcgtcgggcgagatgagcgactccttctgccccgactgcaagaagcatacggaggtggcgttcgaccactcggcgggggacatggtgtgcaccgagtgcggcctcgtcctcgaggcgcactccgtcgacgagacctccgagtggcgcaccttcgcgaacgagtccaacgacaacgaccccgtcc

SEQ ID NO: 5209 - DNA, 297 bp, Zea mays
  misc_feature: Incyte ID No: 700349775H1
  unsure 17: a, t, c, g, or other
catcgagatcaaggacngtcggcgacggcaacctcaacttcgtctacatcgtgcagtccgaggccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctccggaagggcctcgtcgccggtgtcg

SEQ ID NO: 5210 - DNA, 295 bp, Zea mays
  misc_feature: Incyte ID No: 700349776H1
tcgcaattaaaaagctccttaataacatgggtcaggcagaaaaggagttcagggttgaggttgaggcaattgggcacgtcaggcataagaatcttgtacgccttctaggatactgtgtcgagggtatccacaggatgcttgtgtacgagtatgtgaataatgggaacttagaacagtggcttcatggtgcaatgcgtcacacggtgttcttacttgggaggcccggatgaaagtcgttcttggaattgccaaggcgcttgcttatttacatgaagccatagaaccaaaagttgta

SEQ ID NO: 5211 - DNA, 296 bp, Zea mays
  misc_feature: Incyte ID No: 700349777H1
  unsure 196, 200-202, 207-208, 213, 215, 233, 266-267: a, t, c, g, or other
caataatacttaattatttagtctgcaaacatgtaaagtggttgctatttttagatattgagtgctctgcctacaattgagttggatcctcccacaatatctatgacgtttggcgtgaatgattcaccgttggctggccgggatggcactcatgacgggttcatccatcattttcttggaatggatccattcccgnagannngctanncggtngncttcgcgggaacactgtnctgctgtgcaaatgccatgagttcagctggtgnnaaaaccaaacagctaagggagttcagttt

SEQ ID NO: 5212 - DNA, 298 bp, Zea mays
  misc_feature: Incyte ID No: 700349778H1
  unsure 57, 77, 222, 226, 232, 235, 242-243, 249, 260-261, 263, 270, 275, 277, 296: a, t, c, g, or other
ggcagacggcacacacaccacaccacacctccttcgcttccactccgctcgtctganatctcgtccccgtcctttcntttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctanctanagtggnaangggaganntcgtgnagcaaaagatnnancccacgnatgangnggtggtgctacgaaacgtngg

SEQ ID NO: 5213 - DNA, 302 bp, Zea mays
  misc_feature: Incyte ID No: 700349780H1
  unsure 107, 158, 161, 240, 252, 254, 271, 294: a, t, c, g, or other
aactagcaagcgccgcatccctcgcctcttcccgacttgccccctcgattcgatccgagcttacttctagggttcttggccccgctccaccgtcgcccatggcagangatgccaaccgagcggccttcatggagctgcagtcccggatgatagatacnacngcgaagatcaagcagttacaaacccaaatgcgttctaaagaaggggaaaagaagcgtccctaccttactttggaggaanttcgcaattccnanatgataccaacacctanaagatgtcggaaaatgtaagtanacgaggaa

SEQ ID NO: 5214 - DNA, 189 bp, Zea mays
  misc_feature: Incyte ID No: 700349783H1
  unsure 59: a, t, c, g, or other
gcaagttgggcttcgttctcgagtactcttcgttctcaggcggcccccggctgcttctnctggtcgccgcccagctaccagttattagagaaataagggccagcctggttgcccgaggctgacccagcacctgcgatggaggagaaggctgtcacaaatggagcggcagtgctgatgttgctgctcctg

SEQ ID NO: 5215 - DNA, 188 bp, Zea mays
  misc_feature: Incyte ID No: 700349784H1
  unsure 128, 166: a, t, c, g, or other
atcgtttcttttcttgttggccttctccttgccttgcttttgcttgctcgttgcttcttgagctcgagcccgccccttctgcgccttgcccaagtctctgtgtgttttttataggcttgagagcttgnaatagcggggggtggaggaagcggaagaggagcttcgntttgtgttctagagggagtcat

SEQ ID NO: 5216 - DNA, 287 bp, Zea mays
  misc_feature: Incyte ID No: 700349785H1
  unsure 59, 135, 161: a, t, c, g, or other
agcttcgcagcccgcgcccctaaaaccctagccccggcggatcgcggggcgcctctggngccagcgacgcggatccaaggacgggagcgctggcgcctcaggaatgttctcaaagagtggtggtaaggatgggantaggcttagcggctgtagtagtcgancctcttcagcttccatgcctccaagtgtgaagactgaatgtgaaatcctgcaatccgccaatgttaagatcttcaccttcaataatctcaaggcagccacaaggaatttccgtcctgatagtgttc

SEQ ID NO: 5217 - DNA, 277 bp, Zea mays
  misc_feature: Incyte ID No: 700349786H1
  unsure 51, 257, 270-271, 273: a, t, c, g, or other
gatcttcttagaaattgctcaagcatgcaaagcttggcatgtaattactgngatcaaatatccgaaagtggtctgggagtactgtcaggattgtcaaacctatcttctttaagcttcaagcgaagtaatgctgttactgctgaaggaatgagagcctttgcaaatttagttaacttactaaatctcgaccttgaaggttgcctaaagaatcatggtgggcttattcattaaaagatctgacaaagctcgcgtcatgnatatgagtgttgnngnattt

SEQ ID NO: 5218 - DNA, 286 bp, Zea mays
  misc_feature: Incyte ID No: 700349787H1
  unsure 43, 154, 240: a, t, c, g, or other
ctgcgtggcaaggtcaggggctggtgccgcaagttcaacgtgnacgaagccatcgccatgagcgtgctggagaggaggttcaggaggagctaccacccggcgtggtcggcggcattcatcctggacccgctgtatcttatcaaggacgtcagcnggcggtacctcccgccattcaagtacctgacgccggagcatgagaaggacgtggacaggctgatcacgaggctggtgtcgccggangaggcgcacctggcgatgatggagcttatgaatggcggtcggaggc

SEQ ID NO: 5219 - DNA, 289 bp, Zea mays
  misc_feature: Incyte ID No: 700349788H1
  unsure 271, 283, 285: a, t, c, g, or other
aaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaantaaagtcgcgcnantcca

SEQ ID NO: 5220 - DNA, 292 bp, Zea mays
  misc_feature: Incyte ID No: 700349789H1
gtttgctgaagtccctggtgtggaccgtggagtctcagggagaagcgcatgcgcacgccaatcggcaatccaccaaagattccgttctcccagtcgcctctcccagtcccagatctcgttcactcgcactcgcgcaaccccgcggccccgcgcctaatggcatcctgtggcgccggcgacgccgcgtcaggcagccgagggccagtatctcgcacgtcatcttcgatatggacggccttctcctcgacacggagggcttctacacggaggtgcaggagaagatcctagcgag

SEQ ID NO: 5221 - DNA, 290 bp, Zea mays
  misc_feature: Incyte ID No: 700349791H1
  unsure 41: a, t, c, g, or other
attcgaagcaatataacatgattttaatatttgtgattganttgttagatccattagtcattaagactatatcgtctgcatattgtatatgagaaatacctttctcatttaaggatcctaagacacccacaattaagtgaggacattggtacaaacttgtccacccttgactgtttgcatcacccactttcaggctggtgtcttaaatttaagtagctaatctgttactgcctgttatgcatttctaatatacatcatttttattgagctgcttccctaattatgtactt

SEQ ID NO: 5222 - DNA, 168 bp, Zea mays
  misc_feature: Incyte ID No: 700349792H1
  unsure 18, 160-161, 164: a, t, c, g, or other
ctaaacccagcaccagcncccccaatcctccaacttccactcgagtagggttctgccggccgtttcctcgtccgtcgcaatggagttctggggtgaagaagtgaagccaggagccacggtttcttgcaaagttggtgatggtttggttatccactttcannggntgcc

SEQ ID NO: 5223 - DNA, 108 bp, Zea mays
  misc_feature: Incyte ID No: 700349801H1
  unsure 3, 48, 53, 93: a, t, c, g, or other
ggntggggtttcgagaagctcgtcttccgtaatttcgattcaccaganttcangcgagagccgacaaattatgacgattccgagcttcggaangcgtaactccaacag

SEQ ID NO: 5224 - DNA, 117 bp, Zea mays
  misc_feature: Incyte ID No: 700349802H1
  unsure 49, 69-70, 86, 107: a, t, c, g, or other
cttcgcctcccttcccttcctacgacttcacctacaccaccatctcacngcttccattccgcacgcagnngtccaccaaccgacgncaggcgaggagatgaacggcntcggcagttc

SEQ ID NO: 5225 - DNA, 103 bp, Zea mays
  misc_feature: Incyte ID No: 700349803H1
  unsure 60, 98: a, t, c, g, or other
ggagcctgactatgcaaaatacagggatatggttcatcttgcaattgagcggcatttggncaggtgcttacaagcttccagcattcaactaccaaganaacaa

SEQ ID NO: 5226 - DNA, 118 bp, Zea mays
  misc_feature: Incyte ID No: 700349807H1
  unsure 106, 112: a, t, c, g, or other
gcaactggtgggaagactttcttcttgtggggtggctgtatgatgatgcatgctgatgattttaggcaagaccggtacggcattgtcagtggattaagagatggcngttacnccgatg

SEQ ID NO: 5227 - DNA, 109 bp, Zea mays
  misc_feature: Incyte ID No: 700349808H1
tctcatccaatgtacatggattaacatcaaaccgaataagccctgagttggactgtgaatttcagaaataagtgaattgagaaataagtgaattggattgtagaatttc

SEQ ID NO: 5228 - DNA, 108 bp, Zea mays
  misc_feature: Incyte ID No: 700349809H1
  unsure 2, 28, 66, 79, 86: a, t, c, g, or other
gncacacctcccgaactacaagtttcgnttctcgtcgcgacgactgggcgagaccgccgccgccgnctgagttctgtanaaatggntgatggtgaggacatccagcct

SEQ ID NO: 5229 - DNA, 108 bp, Zea mays
  misc_feature: Incyte ID No: 700349810H1
  unsure 2, 39, 104: a, t, c, g, or other
gnatgacattcttgctcaggtttcaacgaaaaccgagtncaaataagaatgctggaaatgctattttatatgaatgtgtggagacaataatgagcattgaagcnacaa

SEQ ID NO: 5230 - DNA, 109 bp, Zea mays
  misc_feature: Incyte ID No: 700349811H1
  unsure 14, 27, 40, 47, 50, 59, 97: a, t, c, g, or other
tacatctacaaggnctacgccgcccgntgcgccggcctcntccgcgntanacacatctnatgttcgacgggttctacagcatgtgcgacccagaganggagaacctgtg

SEQ ID NO: 5231 - DNA, 117 bp, Zea mays
  misc_feature: Incyte ID No: 700349812H1
  unsure 3, 12, 35, 41, 52, 73-74: a, t, c, g, or other
ggntggacaggnaatcagtgatggagatgatgtgncatgcnatgttctgagntgttgcaacctgttggttccnnattgtacaattcccctttcttggcaatggactgttccatgggc

SEQ ID NO: 5232 - DNA, 144 bp, Zea mays
  misc_feature: Incyte ID No: 700349813H1
  unsure 4: a, t, c, g, or other
gganagagaaggcaccaccagcactaggcccttattctcaggccatcaaagcaaataatcttgtgtttgtttctggagttcttggcttgaatcccgagaccaggaagtttatctctgaaaatgttgaggagcaaactgaggcag

SEQ ID NO: 5233 - DNA, 302 bp, Zea mays
  misc_feature: Incyte ID No: 700349815H1
  unsure 122, 292: a, t, c, g, or other
gtgaatttgagagcaaccatttggtgggacgcttccagctgacaatggtcaggacatagcaattgctggtggtctgaaccttgcatgatggagatcgcattgaactgcttttaactttcgcngcactatataccatcgtttggctcatggtgtatgactttcaggcactggagtttctaatggtaatgatcaaggagctcctgctatctcatggttgtcattcgacctctacaagtctacatcaccaaatcaaagcatgtttgtcggatctgccgtgcatgaacaaaagtcntccatgcgaa

SEQ ID NO: 5234 - DNA, 101 bp, Zea mays
  misc_feature: Incyte ID No: 700349818H1
tccaccgccgttcgaatattccaagcttgagattggaggaggaggggaggggaggggagccgagcgcagaaccctaattacctccatcgattgctaacagc

SEQ ID NO: 5235 - DNA, 102 bp, Zea mays
  misc_feature: Incyte ID No: 700349820H1
  unsure 61: a, t, c, g, or other
gtcgcctttgattgagcagggactgggagagaggagaagagagggtgaaagggggcaagancaacgcttcttgttgcctttgtgcttcagcggatccgcggt

SEQ ID NO: 5236 - DNA, 108 bp, Zea mays
  misc_feature: Incyte ID No: 700349822H1
  unsure 2, 41, 82: a, t, c, g, or other
gncagagtgtgcaaatggtggcaaatggactgctgattttncaccttattacaaggctggagttagagcccaacctttgagnaccatgtggcttgaaacgttgatggc

SEQ ID NO: 5237 - DNA, 106 bp, Zea mays
  misc_feature: Incyte ID No: 700349824H1
  unsure 9, 63, 90, 101, 103: a, t, c, g, or other
ggggaaggnaacttttgatatcaacgaggtggctgtgacccatgttaatagtgatttttcttncaaagaggattcaatgcttggggaggnaaatatgaatncnggg

SEQ ID NO: 5238 - DNA, 103 bp, Zea mays
  misc_feature: Incyte ID No: 700349827H1
  unsure 71, 81, 88: a, t, c, g, or other
gtcgactggttcgtctccatccgcctctcgtccccttctgctaccatcgaaggtcccttcgcgatctcgcnttcgagtagntagtgcntcgcgcgccgggggc

SEQ ID NO: 5239 - DNA, 189 bp, Zea mays
  misc_feature: Incyte ID No: 700349829H1
  unsure 86, 91, 118, 128, 136, 177: a, t, c, g, or other
gggggattactcattctgctcccgacaaataatgacagtgtggatgacaaggggcaattcaaaggtgtactgactgagctggagangttgnttctgcatgaacaagttccatatccantgtactttgntttgcatnacgacaatcttgataacctgctggcagatatccataaaatngcctccacaggt

SEQ ID NO: 5240 - DNA, 93 bp, Zea mays
  misc_feature: Incyte ID No: 700349833H1
  unsure 2, 36: a, t, c, g, or other
gntttcataggatcatagcgtagtattgtgtggcgntcattaacagtctgacaattgcagttgaatggaatatgttaggctaatgctggagat

SEQ ID NO: 5241 - DNA, 98 bp, Zea mays
  misc_feature: Incyte ID No: 700349835H1
  unsure 2, 71, 78: a, t, c, g, or other
gngcctcctccggtccgaactccgtactgcttcatactgagcgtccgggaggacaaaacacgcggcgaggnaccaggnatggcgattgtgcgggagga

SEQ ID NO: 5242 - DNA, 103 bp, Zea mays
  misc_feature: Incyte ID No: 700349836H1
  unsure 3, 35: a, t, c, g, or other
ggngatccttttcactttcaccaccagggtacatnagaccgcatactgcggtgctactgcgcttcctacagactacgacttgttggttacataccattccagc

SEQ ID NO: 5243 - DNA, 92 bp, Zea mays
  misc_feature: Incyte ID No: 700349838H1
  unsure 2, 26, 36, 40, 45, 51, 64, 67, 70: a, t, c, g, or other
gngcttcccatcccgatcagcctgcngcagtgccgntacnttccntccctntacccgtggccgntgntgncatggacgaagtcgtacagcca

SEQ ID NO: 5244 - DNA, 85 bp, Zea mays
  misc_feature: Incyte ID No: 700349839H1
  unsure 13, 61: a, t, c, g, or other
gttcctcaggtgntgagcagtcgccggcggcgaccgccggtgtcggagatgaaggagagangcggctccagggcggcggtggacg

SEQ ID NO: 5245 - DNA, 111 bp, Zea mays
  misc_feature: Incyte ID No: 700349841H1
  unsure 2, 43: a, t, c, g, or other
gncaagcttccctttcgttcctcctcgccccagcgacgcgganctacccgtagaaccgagcaagggcaacccaccactgagagggcacgcaggaggagcaggaagccggag

SEQ ID NO: 5246 - DNA, 292 bp, Zea mays
  misc_feature: Incyte ID No: 700349844H1
  unsure 2, 158-159, 180, 233: a, t, c, g, or other
gnaagacatcaacaacgatgaaaatgctttggtgaatgatgtggaagagagatccaaagaagaacatccttctactgagagcctgaaaggcagcaagaggaggtcttcattctcagctaagcctgaatatccagaaaatggctccaaaaattctccanntctgccaagctacatggctgnggcacaattcagcaaaggcgaaactgcggggaatagcttcaccaaaacttagntctgattcagcagagaaaaacggcttcattcgtcgtcactcccttccatcctctaacaa

SEQ ID NO: 5247 - DNA, 217 bp, Zea mays
  misc_feature: Incyte ID No: 700349845H1
  unsure 2, 42, 70: a, t, c, g, or other
gncaagagccctccccggctcaatctactgtgaaggtgaggnaggagaagctaggggatcgaataactgntctccaccagcttgtctccccgtttggaaagactgacacagcgtctgtactccttgaagccattgggtacatcagattcctccatagtcaaattgaggctctgagctccccgtacgtgggcggcagcaatggaggtgggggcggctc

SEQ ID NO: 5248 - DNA, 105 bp, Zea mays
  misc_feature: Incyte ID No: 700349846H1
  unsure 19: a, t, c, g, or other
gtccgagtaaaggaaagcnacgactccgcgtcccgcttccctttccccgcacggtggagttcacaatccccaccggccggcgtagggatattgcgagttacgacg

SEQ ID NO: 5249 - DNA, 302 bp, Zea mays
  misc_feature: Incyte ID No: 700349849H1
atatatgctcagctgaggaagaagtattacctgaggttactgctccaggtgttggttatgagcagactgctgcctctgtagagttgaactcggataagctctcacagccatctgatgtcaacaattctgatgccctagcagctagcagtgaacgttcacctcttgaatcccaaagccggcagtgaggagctgtaccaaggtattatgcaggatggcgtaggaagggctgtagacctgacaagctagtggctacagcgatctttgccagaagctggaggagagttgacatccagtggagctgg

SEQ ID NO: 5250 - DNA, 296 bp, Zea mays
  misc_feature: Incyte ID No: 700349851H1
  unsure 2, 242, 287: a, t, c, g, or other
gngaatccccaagcaaacaaacagggtagagggagaggagaggagaggagaggagaggttgggtctgggacaccatggcttccgatgaagctgtacggggcggtgatgtcgtggaactgacgaggtgcgcaacggcgctggaggaggctggctccgactacgagatcgtgcccatcaacttcgccaccgccgagcacaagagccccgagcacctcgtccgcaaccctttggtcagttccagntctgcaggatggtgattgtacctcttcgattcagagcatctgcantagtgctcg

SEQ ID NO: 5251 - DNA, 296 bp, Zea mays
  misc_feature: Incyte ID No: 700349852H1
  unsure 51, 80: a, t, c, g, or other
gtctgacatgcgtgcgagtcgacgggttcagaaacctgagatgcgcaaggnagctgacgagcgggaggccctcacgggcngcaccgctggccgaccctgatcttctgtgaagggttcgagttggagcacgcctgtcgggacccgaaagatggtgaactatgcctgagcggggcgaacagaggaaactctggtggaggctcgaagcgatactgactgcaaatcgttctctgacttgggtataggggcgaaagactaatcgaaccatctagtagctggttccctccgagtttcctcag

SEQ ID NO: 5252 - DNA, 300 bp, Zea mays
  misc_feature: Incyte ID No: 700349853H1
atcgcctatggccgcgccagttctggcatcaccgtgcggcggatcacaggctcctccccgtttgctggcttcgcggtcggaagcgagacatcaggtggcgtggagaacgtccttgcagagcacttgaacttcttcaacttcagggtttgggatccatgtacaagaccaacacaggcaggggcggcttcatcaggaacatcactgtctcggatgtgacgctggataacgtccggtacgcctgcggatcgttggcgatgtcggcaatcaccccgacgacagtacaaccggatgcgtcccgat

SEQ ID NO: 5253 - DNA, 295 bp, Zea mays
  misc_feature: Incyte ID No: 700349854H1
  unsure 23, 222, 269, 274: a, t, c, g, or other
attggctttgagggctatgagangcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttcagtccgagtccagcctcttgtgtatccccacaaggttgttncgaagactgtgggacgacgaagctgctgctcgccattcctcgcatcntgagntgctgcaggctgtcatgcctc

SEQ ID NO: 5254 - DNA, 297 bp, Zea mays
  misc_feature: Incyte ID No: 700349855H1
  unsure 209, 223, 226, 239, 272, 295: a, t, c, g, or other
gggattagacagatggaaattgaaatagaggaactcaggaaacagcgagataatgcacagtcagagctcgaagaactgaggaagaagaaggttgatcaccagccagggtggaatccctttgactcgccacaaaaggcgcgaaagtgcttacattttcaggatcgctagagccaagtaacaaaaataagatgatgatgagtcgattaggncaatctctactgcnccnttatgttaaagcngaattccgcagctggagcagctacaacaacagntgaggttgaagcaaaccgggccntg

SEQ ID NO: 5255 - DNA, 287 bp, Zea mays
  misc_feature: Incyte ID No: 700349857H1
  unsure 2: a, t, c, g, or other
gnggtggatggaatgagggttctgggaacagtcgtagggaaggactgatgtcatacaagcagttcattcaggaacttgaagatgatgtttcaccagttgaagctcaaagcagatatgaggagtacaagtcagagtacatcacaactcagaagaaagcttactttgccctccataaggatgaagattggttaagaaataaataccatcctacaaacctgaaatgtcttgaaagaaggatgaacggcagaatactgcagatgtttctcctacattgcaagtggagtcgg

SEQ ID NO: 5256 - DNA, 281 bp, Zea mays
  misc_feature: Incyte ID No: 700349858H1
  unsure 256: a, t, c, g, or other
ctagcattggtgccgagaagttgcaagatcagatgaacgagctaaagattagagatgataaggaagttgaagcaaccataattaatgggaaagggactgaaactgggcacataattgtcaccactactggtggcaagaatggtcaaccaaaacagacagtgagctacatggcgagcgcattgtaggtcaaggttctttgggattgtctccggctaatgtttggagacggtgagacgttgccataaagaggttctcngataagcttacagaacctgattgca

SEQ ID NO: 5257 - DNA, 286 bp, Zea mays
  misc_feature: Incyte ID No: 700349859H1
  unsure 2-3, 96, 162, 170: a, t, c, g, or other
gnnaggtgttcgtgggaatcaggtatcacttcttaacattgttgttgaattgaagaaatgctgcaaccatccattcttgtttgaaagtgcccgatncatggttatggtggagatagcatcggtgatcggaataaagttgaacgtattgttatgagtagtgcnaaactgtnttgttggacaaactattggtgagacgcgggagactaaccatcgtgtgcttatatctcacagatggttaactgttggacatcctgcagaataccctctctcgggattcatttcgagg

SEQ ID NO: 5258 - DNA, 283 bp, Zea mays
  misc_feature: Incyte ID No: 700349860H1
  unsure 32, 76, 246, 251, 261, 268-269, 282: a, t, c, g, or other
tggagggagacagctcttatattgacatccancccttttcgctgcagttgtgttctggttcattggcatatttgtnccccagcgtcgaccgtttcaacgaagagagcgagtatggccttactgccgccgagagatcaagtgctcaggccactgcttggtgaaaacgagccacggacatcggactaaaatcgcgcaatccataaccattatactggaaggcatctaggtagtttgttttcccccagntatanagttggttanataaaannagctaaaagagtnc

SEQ ID NO: 5259 - DNA, 294 bp, Zea mays
  misc_feature: Incyte ID No: 700349861H1
  unsure 2: a, t, c, g, or other
cncgctgcccccttactcatcctccccgctgctcgaaggagagccaaatccagagcgccgccgcgatggcctcccctgacgcggaacagccggcgccgacggaactcgagcggtggcgtgacctcgacatgctcttgtacccgccctggaaacctcgtggaggccactttgcgatcccagccccggcctgcgagacttactggggagcctcgtggaggttttggttgtgggcgcgggcgggttggctgcgagctcctcaaggactggctctctccgggtttaagaaatgcagtc

SEQ ID NO: 5260 - DNA, 294 bp, Zea mays
  misc_feature: Incyte ID No: 700349862H1
  unsure 12, 132, 251, 290: a, t, c, g, or other
ctcgctcccggnattcagcgtcgggcaagattaagatcggaattcaacggcttcggaaggatcggcaggctcgtggccagggtcgccctccagagcgaggatgtcgagctcgtcgccgtcaacgaccccttncatcaccacggactacatgacctacatgttcaagtacgacaccgtccacggccactggaagcacagcgacatcacactcaaggactccagaccttctcttcggtgacaagcggtacacntctttggcatcggaacctgaggaatccgtggggtgaggnggcc

SEQ ID NO: 5261 - DNA, 292 bp, Zea mays
  misc_feature: Incyte ID No: 700349863H1
  unsure 42, 129-154, 182, 188, 268, 281: a, t, c, g, or other
ggttagtctgctgtcatcaagcctttctatcaaagttttggnatctggttcagtttcagcacaagttctagtgttagcttcgtgggggaaagaaaaaaaagaaggaaaaaaaatccaagaaagttctgnnnnnnnnnnnnnnnnnnnnnnnnnnatttgaaaaagccaaaaaaaaaagtatncaaaantggaaaaaaaatagtgatgatgtcataggcctaggattatccccccgggtagccgccagagatgggtcggccttctggtncgtgtggagtgtntcttagccttt

SEQ ID NO: 5262 - DNA, 301 bp, Zea mays
  misc_feature: Incyte ID No: 700349864H1
  unsure 104, 295: a, t, c, g, or other
gtagcttcttcatgtcatgaatgactcagatatttcaatggttttaagcaccaaggagcatcacgaaatcatggagaacctttctatcaagtgttctgcttatngttctattcttccatctgtcactagtataccttcagaaatcaatcctcaagaaccttcaagcaatgaggcgatttcatcagtctctactttaataactgagaccaacagttcaaagaaaatcaaaggcgatgaccctgctcttatcctttacacagtggcacaactggtaaacctaaaggagtagttcacncccaga

SEQ ID NO: 5263 - DNA, 294 bp, Zea mays
  misc_feature: Incyte ID No: 700349865H1
  unsure 2, 14, 268, 283: a, t, c, g, or other
gnatccctcgctgnccccacactccagaagtccagaccaaagctctaaagtccaatccctcgctagccacttgccatctgatcaaccagccagccgatctcagcgatccgccatggccaccgcgtattacgagaggccccgtggcggcgccgtcgaggaggcggacgacttcgatgagttcgaccccacgccgtacggggtgggtacgacctcgccgtcaccttcggtcgcccgctgccacgtccgaggaaactgctaccgtgtcggngccctcgactctacntgcacgcatag

SEQ ID NO: 5264 - DNA, 290 bp, Zea mays
  misc_feature: Incyte ID No: 700349867H1
  unsure 22, 118: a, t, c, g, or other
gtgcgaggagagcatagatttnttctttcccttgccgttgccgcttccgtttctcgcttccattcctctctgctcgtgggtttgtcgaagataaacctcgcataaagcttcgttcgtnggcttttggtatcaatcggcagggctcccccgtttcctctctccaagatcttccccccttttctctgtctccaacccgcggaaatccttggaggagttgcggaaattgtagcagaggttttccttccagctttcctgctgcggggcctccgcaggtttttgatcggggaggc

SEQ ID NO: 5265 - DNA, 288 bp, Zea mays
  misc_feature: Incyte ID No: 700349868H1
  unsure 4, 37, 46, 48, 125, 199, 201, 280: a, t, c, g, or other
gcangcgaccatcgacaaagttgatctagatctagangttgtcaangnatgaagtcggtggggaaggcggagttggcatggatgcttccaacatcggaggccatgaggaccacatagcgcgggcnctcggcgtcggcggtgaagaaggcctcaaagttagcctggcgggtgaggtcaagcttggcgtgggtgtgggccncnacgcagtgaagacaagcagaggaggcgacacacgatggtttaaccgacaagatcttgcgcccgacgacgagaccttgcncctgtcga

SEQ ID NO: 5266 - DNA, 293 bp, Zea mays
  misc_feature: Incyte ID No: 700349869H1
  unsure 2, 107, 122, 129: a, t, c, g, or other
gnattctcgaattacgattcccaatccagcaaaccctaccagccttttgcaaactcagagagggacccgatggcacccaaggcggagaagaagccggcggcgaagangcccgcagaggaggngcccgcngccccggcggagaaggcccccgctgggaagaagccgaaggaagaagcggctcccggcgggaaaatccgccggcaaggaaggcggtgttgacaagaaggggcggaagaaggccaagaagagcgtggagacgtacaagatctactcttcaggtgctgaagcagtgc

SEQ ID NO: 5267 - DNA, 292 bp, Zea mays
  misc_feature: Incyte ID No: 700349870H1
  unsure 55, 95-112: a, t, c, g, or other
ccttctgggcgcaccaggaaaaaaattgatacattcctcggcagctgcgcgagtncctctgttgatacccccggcgacccaaagcccccgtccgnnnnnnnnnnnnnnnnnnctaacaggattggggatttttttttgcttcgtgttctccttctcctgctgtaggcgttgattcgggtgatgagagatgggcttcttggcgtgcttgtgccgatgccctcaggacggggacgacgacgagaaggagggggagcattcagaatcaaccaccagtcgcctcagtggactaccc

SEQ ID NO: 5268 - DNA, 279 bp, Zea mays
  misc_feature: Incyte ID No: 700349871H1
  unsure 276: a, t, c, g, or other
ctaacctcaaggtgggttcggttcttctcggctgtgccttcctgtatgatatcttctgggtgtttatctccaagagatggtttcatgagagcgtgatgattgtggttgcgcgtggcgacaagaccgacgaggatggtgtgcccatgctgctaaaaatcccgcgaatgtttgatccatggggtggatacagcatcattggcttggtgatatcctctccggtctttagttgcttctcgctaagatacgattttcgcaaagagggctacggtcggttanttt

SEQ ID NO: 5269 - DNA, 288 bp, Zea mays
  misc_feature: Incyte ID No: 700349872H1
  unsure 20, 42: a, t, c, g, or other
ttcaaaggacagggttccgnacatgaaattcaatgtcgctanagtcctgcaatcacttgtaccaatccttgatcaatctgttgtggagaagacagtgaaaccatgcttagttgagctcagtgaggacccagatgtagatgtaagatactacgcacaccaagcccttcgggcgtgtgaccaaatggtgatatctagttgactagcctgtccaggaattagcaaatgagatacatattggtctatcttttgaacatttaaagtgttatgtagtctaaaaaatatgtacca

SEQ ID NO: 5270 - DNA, 288 bp, Zea mays
  misc_feature: Incyte ID No: 700349873H1
  unsure 4, 38, 266, 270: a, t, c, g, or other
gggnactcaaaaatagatgttgaatcttcacatgaggnatgctttatgaacttaacacagcaagtttatgttccaccacacttaactattcaattaaaccacaccacagagcacaaatgttttaccatctaatactcctgaaaattcccccatcgcattagaaacgccaacgaaaaggttcttacaactcctttttttctcttttaactttaaacattactttaccaattaccagacaaatattgttcctaatacattcctcaganaganatattgtcacaggctcag

SEQ ID NO: 5271 - DNA, 290 bp, Zea mays
  misc_feature: Incyte ID No: 700349875H1
  unsure 11-12, 133: a, t, c, g, or other
accgaattccnngcgattcctctcccctcgcctcctcgtctccccctaggggaacgtcggagaggaatcgcaaagagggccgtctcatccgagttaaggaagccatggagcacaaggaggctgggtgccaggncccccgagggacccatcctctgcatcaataactgtggcttcttcggcagcgcggcgaccatgaacatgtgcttccaagtgccacaaggagatgataacgagcaggatcaggccaagctggctgcctcctctatcgacagcatctgaaggcgcgacgc

SEQ ID NO: 5272 - DNA, 281 bp, Zea mays
  misc_feature: Incyte ID No: 700349878H1
  unsure 207, 213, 274, 278: a, t, c, g, or other
gtctcaactgaagttttggtgattttgaagatgaacttatccaccagtccttgaagtcgtgagctttactatttattaatcacagtaagcagatgaaaaaagctcatgttttttcagaggacagcaagaatctgaaggtgcatgattctctacctatatactggtttactactacatatttctgcaattctgtgaacttgcaagccncattcngctcacctcaggaaactttgaataggtgacgccagttaggaggaccacgcgtaagaccctntgcncgc

SEQ ID NO: 5273 - DNA, 285 bp, Zea mays
  misc_feature: Incyte ID No: 700349879H1
  unsure 279, 284: a, t, c, g, or other
gttgaggagataattggggagaatgttcgtgccatctgcagaggtgatagctgcaagttccatgctgctgggagagaagacattgatgtacggatgcttggatctggtcgtccatttctagttgaagtactgaatgttcgatccattccatctgaaactgaagttcaacaaattgaagagagattaacaactcgaaaagaaatatgtcatagttcgaatctcagttggtagatatgaaatatggaccagatgctgaaggagagcagagaaacagaagcntacang

SEQ ID NO: 5274 - DNA, 287 bp, Zea mays
  misc_feature: Incyte ID No: 700349881H1
  unsure 16, 218, 239, 264: a, t, c, g, or other
ctgaagagcgcaagtnccagcttctcttctgaaggaagctatacatgttatcagctgcggctacgaagacaagaccgactggggaaaagagattggctggatttacggatcgatgcacagaggatatcttgactggatttaagatgcactgccatggctggcggtctatttactgcatcccgaagcggcctgcatcaaaggttctgcgcctctgaacnttccgaccgtctcaccagtcntcgctgggccctgggtccgtcgaantttctcagcaagcatgcccattt

SEQ ID NO: 5275 - DNA, 282 bp, Zea mays
  misc_feature: Incyte ID No: 700349882H1
  unsure 116, 122, 125, 231: a, t, c, g, or other
gcaatgaagtacaagtcggaaggtcatgacatggtcatcattgctggctccgagtacggcagtggcagctctcgtgactctgctgccaagggaccaatgctactgggtgtcaagtnggtganacnaaagagcttcgagcggatccaccggagcaacttggtggggatggggatcatctctctgctttaaagcaggagaggatgccgattcatcggcctcacggactgagcntacaccatccactccctaccagcacgccgagctcagtccaggccaggagtg

SEQ ID NO: 5276 - DNA, 283 bp, Zea mays
  misc_feature: Incyte ID No: 700349883H1
  unsure 268: a, t, c, g, or other
gtatcaggaaactggagcaaagtactgcccacttgaccatgttgcaatgaatcaaaatgaggagctatttactgttagcaacagttcactttcagagtttgctgttctgggtttgaattgggttactccatggagaaccctaattcattggtacttgggaagcacaatttggcgattttgccaatggtgcacaagtgatgtttgaccatttttgagcagcggcgagggcaaaatggttgcggcaaacggcctgttgttcgttgcctcnggttatgaggccagg

SEQ ID NO: 5277 - DNA, 278 bp, Zea mays
  misc_feature: Incyte ID No: 700349885H1
  unsure 228, 269, 273: a, t, c, g, or other
ggcattgcaactggagtccaggtcttcacaagttgatgagcttcagctgatggtggcatcgctggaaaagaatgtagacaggaaggtgttggaattgcagttagagttagtttctgtggaggctgcagatcgcgcaagacagtggctcccggaagagaagattgatgcgagataactctctctatgcagcacaaaacaatgcagaccggcagaggctccaaagaatcntagaggcgcactgcagtctgcaaacacagagatagggaaangaanggatg

SEQ ID NO: 5278 - DNA, 280 bp, Zea mays
  misc_feature: Incyte ID No: 700349887H1
  unsure 3, 55: a, t, c, g, or other
ggntttcacaggtctgaccggaactggattttcaagcacatcattctcgtttggntcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggcccgtcgaaaccggtgaagaaatgagaaggctgtatcagcgctgatcgcttgtagaatattaga

SEQ ID NO: 5279 - DNA, 281 bp, Zea mays
  misc_feature: Incyte ID No: 700349891H1
tcttgtcaagtacataaagggagttggaaacatgagccatgagcaatggcggtcgttccataacgacaagaagacagcggaggcacggaacttccttgatggtgacctgatcgagtcgttccttgaccttagccggagcaagatggaggtggtgtccaaggctatgggcgtttcggtggaggatctgtccaagattgtggaagagctgacgaggcttcactagtacatggatacgcagaagctttgcttgtaacttgatgcagtacatccctttttgccac

SEQ ID NO: 5280 - DNA, 284 bp, Zea mays
  misc_feature: Incyte ID No: 700349892H1
  unsure 2, 68, 73, 82, 87, 98, 108, 120, 127, 140, 151, 154, 187, 190, 193, 196,: a, t, c, g, or other
tngatccaacccaagccacgcctcggcgatcaggccgacagcccacgagcgagatccaacccaagttnccgangccgcgggngagancgattcagatncacctcagcngtctcggatggngtacagntcggcggaggtgnggatgctcccnganggcggcgctgacgacgaagagcggtggctcgcnganggnatngcaggcgtccagcaaaacgccttctacatgcaccgngnnctcgattccaacaacctnaaggancatcaatatcggcgcgatgtctacg

SEQ ID NO: 5281 - DNA, 282 bp, Zea mays
  misc_feature: Incyte ID No: 700349893H1
  unsure 2, 252, 259, 269: a, t, c, g, or other
gncatcttcttttcctcgcttgccctaattccgcatccccggctgaggcagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcngaggaantacgtgtccnttcgaaggttcgc

SEQ ID NO: 5282 - DNA, 285 bp, Zea mays
  misc_feature: Incyte ID No: 700349895H1
  unsure 168: a, t, c, g, or other
aaacccaacacatcgtgtctgcgttctccccctttacgccggcgagtgttcgtcgctagctcgctgcagcggggagaatagaggcagagagcagcgatgagcgacgagcgggtgaaagcggaggcgctgcagatcctgggcctattccaggtgctcccccgcctcgtngtcttcgacctcgactataccctctggcccttctactgcgagtgccggtccaagagggattcgccgagcttttcaggcacgccagggcatcatgtacgcctcaaggagaaggggatc

SEQ ID NO: 5283 - DNA, 190 bp, Zea mays
  misc_feature: Incyte ID No: 700349901H1
  unsure 3: a, t, c, g, or other
ggnctaaaggatatagagttcatgaaaaagaaacttgaggaccttgataagtcaatgaagaggagcaatgataagcagctcaaaattgagcatgaattatgtgagagggtcataggccatctgaggaagggaaagatgtccgtttaggagattggaaagctgctgacattgagatctgaatacttccagc

SEQ ID NO: 5284 - DNA, 118 bp, Zea mays
  misc_feature: Incyte ID No: 700349902H1
ctttactcttccctccacttctggccgcagctttgagcttcagtagcaaacaagaagcagcaagatagtgatccttccatgggaaacaccctcggctttggcgtaggtgtccggcctc

SEQ ID NO: 5285 - DNA, 266 bp, Zea mays
  misc_feature: Incyte ID No: 700349903H1
  unsure 2, 38: a, t, c, g, or other
gnttctgccagggaatagcttctctccaaaaccaccgncattgagaaccaggcagtttgtacgacaaactactctgtgtaacatgattcagatttcagaggtagcaggaatgttgttgattctctagggtagctgtacatttttttaaccattctgtgcataaaggggagatagcagtacagttattcaaaccaatcaaggaggttggcaacatggtggcaagatacatatattggttttggttagcatgtttggttccagagact

SEQ ID NO: 5286 - DNA, 299 bp, Zea mays
  misc_feature: Incyte ID No: 700349904H1
  unsure 2, 19, 38, 117, 190, 196, 290: a, t, c, g, or other
gncggaaagaacaccggangcggagagccacaggaggnggagctcgagggacgacgaccagctgaattaggactggagggggcagacgacgtcgtcgtagcggcagcagcaggagangggaagactcaaacgagggatctccgagagaggagtgtggtaggcaggaagaaagaataaggcgagccgaganccattncgcatggaggcggcgatggatctgatgcggcggatgccccaacggagcgcggagacggcgctcaacgcgctgctcttccctcctccccgaccantccctcgac

SEQ ID NO: 5287 - DNA, 295 bp, Zea mays
  misc_feature: Incyte ID No: 700349905H1
  unsure 2, 285: a, t, c, g, or other
gncgcagtcccaccgaccccgccgccggttcgccctccatctcctcgccgctgcctctccgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataataccacagggctgatggtcanaacatggcaa

SEQ ID NO: 5288 - DNA, 294 bp, Zea mays
  misc_feature: Incyte ID No: 700349907H1
  unsure 2, 10, 19, 133, 135, 173, 259: a, t, c, g, or other
gntccctganaattaaggncaagagtcatgccccaggttccatcatttctgtggcacgggaggctgctagaaagagggttgaagaggcatctgcagctgcaaaacgtgctgaaaacttggatgccatattganancgccagagcttgccgcggaggctgtgttcagggcaggnaccattattggaatgggagaaccactaccttttaccctaagagagcttttggaagcagggccaaatggctattggaagtctaacantgttaggtatagtcggagtggtatgatatctagta

SEQ ID NO: 5289 - DNA, 94 bp, Zea mays
  misc_feature: Incyte ID No: 700349908H1
gtgacaacatggttagttccatgatatataagtgaaaaagctgtttacaggacagcatggttagttctatgatatatcaaattagatcacactt

SEQ ID NO: 5290 - DNA, 293 bp, Zea mays
  misc_feature: Incyte ID No: 700349911H1
  unsure 43: a, t, c, g, or other
gtgccattctacactgtctctgatgaaggggaggtaactgatngccaccaattcagcccaggcggtggtgaacactgtcactgtatcttccaggaggcctgttgttcttgcggatggcacttatgccacacagagcgccgctaccgagaccatttcagccccatcagttgctcatgggtcatagcatctaccctgaacctcagatcactccatttgtcaggtgatttctccggctgctgttgttgcagtacccgaccagcttgtgttgaggcggaagaatgcagccatccagg

SEQ ID NO: 5291 - DNA, 214 bp, Zea mays
  misc_feature: Incyte ID No: 700349912H1
cgcaagcacgttcccgtgctctcgcagctcgcttctccagaggcgactagggtttgaaggctaccgagagggtgctactgacgccaactcctccgaccgcccgcaggcgaaggagctctccgccttcccgccctcgtgtcatccttcccatcgcgacccgcgaggccacgagcccacgagctccagctcttgttattcggaagggttctggatt

SEQ ID NO: 5292 - DNA, 175 bp, Zea mays
  misc_feature: Incyte ID No: 700349913H1
  unsure 3, 8, 45, 101, 123, 125, 133, 173: a, t, c, g, or other
ggnttttntcaacaatgatcagctgtgcctagaggccgggcagcncccacagccggagaaatcctctcgtgtggtctcttcagctactcagacggcaagancgatgctggccgccgagctccncngccgccgngccgtgctcggttgcaggacttctgttcccaccgattctnat

SEQ ID NO: 5293 - DNA, 300 bp, Zea mays
  misc_feature: Incyte ID No: 700349914H1
  unsure 2, 12, 75: a, t, c, g, or other
gncccgctaggnggctgcgggccgatgcacccgggagattcgtggcgtcctgcttgccccctcccgacgtcgtgntgacgcgcgagcagggaaagaacgccaggctcatctccgcgctggaaaagcataatgtacaccctctggaacttccacttattaagcatgttgaaggccctgatacagataggctttcagatgtcctacgtaatgacaagttcgactggatattgtaacctctcctgaggcagctgcatgttcctcaggatggaagactgctggaatcctaaggtgcgagtactg

SEQ ID NO: 5294 - DNA, 223 bp, Zea mays
  misc_feature: Incyte ID No: 700349916H1
  unsure 11, 16, 20, 24, 31, 112, 210, 220: a, t, c, g, or other
gttaccccggnctctncgcncctnccttctncgcggcgctcgagggaccatggccgatcctcgcgtgagatcagattcaagattcaagaccggcgtggtgaagcggttggtncaaagaaaaagtgatgtatgaaaaagaggcaaaacaacaagaagaaaagattgaaaaaatgagagctgaagacggtgaaaattatgacttaaaaagcngcagagatcntac

SEQ ID NO: 5295 - DNA, 209 bp, Zea mays
  misc_feature: Incyte ID No: 700349917H1
cgtggattcaaatgttgatctgcatgttgctgctaagaggattgttgttggcaaatggggatgcaacaacggccaagcatgcattgctccagattacatcataacgacaaaatcatttgcaccggagctggtggcctctttcaaaagagttttggaaaggttctatggggaggatcctctgcaatcagcagacttgtctcgtattgtga

SEQ ID NO: 5296 - DNA, 286 bp, Zea mays
  misc_feature: Incyte ID No: 700349919H1
ggaaggcacaagggagctgcattacaattcctagaaaccatccagttccccagatcccagaggaacctgcgcatctgttcgcttcagctagtgttaaatctcatgctggagtagagataatgaatgaatgctcagatatcaaagaaaagatagttcttggaggttataagcaactaccagagagcactgtgtcacacagattgactgcatcacagaatatgagcagcggaactcttcccataatcttcgcacttatgccaaaactcaggatcgctggatcacacaa

SEQ ID NO: 5297 - DNA, 203 bp, Zea mays
  misc_feature: Incyte ID No: 700349920H1
gagaagaaggcggcgtacagcgaaggtgaagtgaatgatttgcataaagatgacaagggccagggagaggcagtcagattgggcaggaaggatgtgcctccaaagatggaggctgattcttcaacactggatgagcgggttgaggatgaagagaacgatgaagtggagcaagaaatgaagcatgatgagaacgatgaggatcc

SEQ ID NO: 5298 - DNA, 202 bp, Zea mays
  misc_feature: Incyte ID No: 700349921H1
  unsure 41, 73, 130: a, t, c, g, or other
gctgcatacgcagaacttgaatctgtactttctggattgantgtgcttgttgagacttactttgctgatgttnctgctgagtcctacaagaccctaacatccctgagcagtgtgactgcttatggttttnatcttgtccgtggaacccaaactcttgggcttgtcacgagtgctggtttccctgctggaaagtacctctttg

SEQ ID NO: 5299 - DNA, 205 bp, Zea mays
  misc_feature: Incyte ID No: 700349922H1
  unsure 2, 201: a, t, c, g, or other
gncgatgctgggcgcacccccgacacacccgccgtgcccgcccatcgcgtcatccttgccagcagatctcctgttttcagagcgatgcttgagaatgagatggaagagagtaggagtggcgtcatcaagatcgccgatgtgtctatgacatccttcgtgcttttgtccattacatgtacactgcagaagctctctagacgnacag

SEQ ID NO: 5300 - DNA, 189 bp, Zea mays
  misc_feature: Incyte ID No: 700349924H1
  unsure 43, 82, 91: a, t, c, g, or other
ttcgtctgcttcccagagacccagccatggcgatctcccagancttcacgcatattcctggccatccttctccctggccgcngccttcgcngccgccccagctgcgcttgcggacggcgacgacgtggtggcccttaccgaatccacgttcgagaaggaggtcggaaaggaccgcggcgccctcgtcga

SEQ ID NO: 5301 - DNA, 200 bp, Zea mays
  misc_feature: Incyte ID No: 700349925H1
  unsure 40, 198: a, t, c, g, or other
aaaggccgcgacgagccgaccagctctactgcccccttcnggccttcggcgaccgtgacgagcaacgacgaccacggtgacgatggccgcttcctccctctgccacgggcacttgctcctgtttctcctcgtgtccgtcaagatcgatggcgtgagtgcgaagggctatggtcttccagccagtgcatcaaacacaanag

SEQ ID NO: 5302 - DNA, 295 bp, Zea mays
  misc_feature: Incyte ID No: 700349926H1
  unsure 264: a, t, c, g, or other
ggcaatagccctgacagctactgctgaaattgaagagacatttgaaagttgtctatagtttagatgatgcccgctgtcagtcattttctctaaaggagcctccgaaatctggagaaacattctccaggcagaatattccttttaatgttagcagcactaacatcagtctgccgagctgcctgcaggacgtagcttctgtttaccaggatttcaagacagtgctccacgaagattccaggactttgctgtgttcatccctcagtnccagattaggaagcgcccaaccccgagaaat

SEQ ID NO: 5303 - DNA, 289 bp, Zea mays
  misc_feature: Incyte ID No: 700349927H1
  unsure 233, 257, 265, 269, 272-273, 278: a, t, c, g, or other
gccaagttcacaagtatcagatctggtgataaatgaccgggaaaaagaccacggcctcctctgccggccgcactccgaaagaaggccaaggtggtgttggaggatgaggaagaggcagggttggaagatgaggaagaggcgactgtgacactatccgtggagaaggacgcactggagtgtgacattctgctgcctacccttccagtccgaatttttatgtgcaagaacggacntctgtatgtggcaaatgtgcatcngcacgaangtantgnnggacngctccgagcgc

SEQ ID NO: 5304 - DNA, 301 bp, Zea mays
  misc_feature: Incyte ID No: 700349930H1
  unsure 2, 260: a, t, c, g, or other
gnaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatccaggttcgagagttctcactgacaagagcaagctcgatgcgcacctgagcttttcatccacntgtccccagacaggccaggaacacgctctccatcatcgacg

SEQ ID NO: 5305 - DNA, 305 bp, Zea mays
  misc_feature: Incyte ID No: 700349932H1
  unsure 37, 179-201, 233, 304: a, t, c, g, or other
catatatttatattagaaaagaaaactctgttcaacnacccgccgagttcagcagcactctcctccgccctacttccaggtcccagcaaagattggggacgcgtaggcatcggagattgcctcgggagcgcgtttcctggtcaactaaggccggcatgaagggctgcttcagagcgctnnnnnnnnnnnnnnnnnnnnnnngcatcgtcgtcgttatgtccgctgtgattgcngcgcacagacttgccccgccgacctcgacagcaatgcgatggtggcgcgtctgatgatgattgggaggggna

SEQ ID NO: 5306 - DNA, 218 bp, Zea mays
  misc_feature: Incyte ID No: 700349933H1
atgcttggggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccatcatggag

SEQ ID NO: 5307 - DNA, 202 bp, Zea mays
  misc_feature: Incyte ID No: 700349934H1
  unsure 52-53, 104, 110: a, t, c, g, or other
cgcccacacgcacgtttccactccgaccgggccagagccccccgccggccanngggcagtttccgttcgctgttgcgatccacctcctgcctgcacatcccctnccccgngttcgagccggagggccaaagagtagatctgcggcggcggccagaggatggccgtcaactgggagctgcggggctgctgcgaccacgaccag

SEQ ID NO: 5308 - DNA, 275 bp, Zea mays
  misc_feature: Incyte ID No: 700349935H1
  unsure 266: a, t, c, g, or other
gtgggatttgcaactggtgggaagactttcttcttgtggggtggctgtatgatgatgcatgctgatgattttaggcaagaccggtacgcattgtcagtggattaagagatggcggttactcagatgatatgacactcgctggcaatagcaggacagcacaaaaggctcatattttcaccacctgttgctgtgtttccacaccccctggccatgatctagctctccagatacggaattacctcggaaacaaactttgttctcgatcntatgtatcg

SEQ ID NO: 5309 - DNA, 273 bp, Zea mays
  misc_feature: Incyte ID No: 700349939H1
  unsure 2, 174: a, t, c, g, or other
gntcttgataatggaacacagattatcggttcaaatggctacaaattgggtttctttgacaccatcaaaggctatttggttagcttctgggattttctgattgatttaatcagtggcaaatcctgcaggctgaacaaatgtcggagcttttttgactcagctgccatgcgcatnacagatgcataaccggctcgtcatgttggtgcgctacttttagttacccgcagcggcaattgtccgtatctctcatcagaaggctctcgacccatatac

SEQ ID NO: 5310 - DNA, 280 bp, Zea mays
  misc_feature: Incyte ID No: 700349940H1
  unsure 239, 274: a, t, c, g, or other
gtcaaagcagaagattttttccgaggagtttgaacttgttactcaagctctttttacagatccaagtgaccaaagtggatggttctatcacctctggcttttagctcaaacatctagttccagataacccacagctgattgcttcatggccttctaatgctgcaaagctgcagtttctctttatcaaggaaaaggctgagcagcacacactgtcatccgtcggtcaaggactgtacccntgttctttatttaatgagccgtcaaggataaatcntcagtg

SEQ ID NO: 5311 - DNA, 225 bp, Zea mays
  misc_feature: Incyte ID No: 700349942H1
gtgagtctgaagtgaatccttttgatggacaagaggccaagccgtacaagaacgatagtgaaatccttgcaatgacaaacctgattgcagcgtaccagaagaacgacattcatggagtttgaaaagatccgaagagtaatagaagaacaataatggatgatcctttatccgtaactatattgaggatcgttgaagaacatcagaacccagtgcgctcagctatta

SEQ ID NO: 5312 - DNA, 178 bp, Zea mays
  misc_feature: Incyte ID No: 700349943H1
  unsure 8, 104: a, t, c, g, or other
caccccancccccacccacgctcaggggaagggggtctgggttgcgtacaggcgaaaggcacgcgccgccgctgccgcgcgagcctctccgtccccatcgccgngcagatggatccgtcgtcggagcccctgtacgcgcaggtcgagccgtacgactccgggttcctacaaggtctcc

SEQ ID NO: 5313 - DNA, 283 bp, Zea mays
  misc_feature: Incyte ID No: 700349944H1
  unsure 221, 247: a, t, c, g, or other
gtctcggtaacatttgttaacaaggatggctcagaaaagacaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgacctgcnttgggctcacagagacatctcgcctngctgccagtgatcgcgagctgaactcgatggtattc

SEQ ID NO: 5314 - DNA, 93 bp, Zea mays
  misc_feature: Incyte ID No: 700349945H1
  unsure 23, 35, 80, 87, 89: a, t, c, g, or other
gtgccccagacgcccacggactnacttgaactcgnagcctaaaccgattgcaacaggcaacatggtaaaaaactaccgancattgcngnctct

SEQ ID NO: 5315 - DNA, 290 bp, Zea mays
  misc_feature: Incyte ID No: 700349948H1
  unsure 251, 266, 279: a, t, c, g, or other
gggaaagtgttgcagatagatgtctctagtttaacgagctcaagtgctatgttgtccaattgactgtgagatggtccttgcagtgatggcacaaaggctgtggtcagagtatgtgttgtagacgacaagcttaaggctaagttggacatactcgtaaacccatcgaagactgttgctgactataggacacacatcactggtgtatctaagaaggatttagaaggagtcacatccatcatagttgatgttcngtatatgtcttaacnctatgtatttctngatatatatcc

SEQ ID NO: 5316 - DNA, 228 bp, Zea mays
  misc_feature: Incyte ID No: 700349949H1
  unsure 9, 29, 34, 58, 72, 83, 92-93, 100, 105, 111, 122-123, 128, 132, 136-137,: a, t, c, g, or other
ctacaagcncacacgtgctgctgaacgtntgganccttcttaactctctatgggaaancagggcttcctggncttccaatgcngttggtggnngcactgnctctngccttngttctctcctnnttgancgcntgtnngtggantacggcaanaaatccaagctgggcntcactgtgtacccatctncccaggtgtcaactctgttgtggagccntannaacagcgtgt

SEQ ID NO: 5317 - DNA, 299 bp, Zea mays
  misc_feature: Incyte ID No: 700349950H1
  unsure 28, 82, 244, 285, 289, 292, 296: a, t, c, g, or other
gtacgcaggccagcgcagcctccgagcngtcgccatggcgagcaagcaccttcgtcctcgccgcatgcctcctccacgtgcncaccgcctcggtcgccaccgacgtcgactactgcagtaagaaggactacccggtgaaggtgagcggggtgcagatcgtgcccgatccggtcgaacccggcaagcccgccatttcaagatctccgcttctatgataaaaccatcgagaagggaagctggttancgagtcagtattcttcttctagtgcatcggagaccgcgacnctgnganagantcc

SEQ ID NO: 5318 - DNA, 296 bp, Zea mays
  misc_feature: Incyte ID No: 700349951H1
  unsure 23, 48, 92, 123, 208, 255, 279, 294: a, t, c, g, or other
tccgtggccaacctcgccgagtngctgtccacgctcatatggatcgcntccgcgctgcacgccgccgtcaacttcggccagtacggctacgngggtacatgcccaaccgccccacccggtgcngccgcttcgtgccgctgccggactccccggagatggcgcagtggaggccgacccggacaggttcttcctcgacacggtgcccgancgcttcaccgccacgctcgggctcagctcatcgaggtgctctccacnaaacctcgaagagctctaccgggnaagcgcgcacagggngt

SEQ ID NO: 5319 - DNA, 294 bp, Zea mays
  misc_feature: Incyte ID No: 700349952H1
  unsure 189, 214, 217, 248-249, 254, 259, 291: a, t, c, g, or other
gaaaacctaattgtcccgcttaacccgagtagaatctttagcatgacagggctttggagtcctgctctgctagatctatgcacgcagagtcctggcactagagatgctcaaattattgcatgtagaagaacatatatgagaagagagagaggtctcctaaaaaggagtatctatgagttgagttgtgantagctgagagagtagaagtggtgcngcnctttctataggtgcacaagagatcggttccnnaaacnggacnccctctagtagcttgatggtcaaaaacgtccncat

SEQ ID NO: 5320 - DNA, 294 bp, Zea mays
  misc_feature: Incyte ID No: 700349953H1
  unsure 56, 65, 149, 163, 172, 279, 285: a, t, c, g, or other
ggatcggcacctcgccgtcctcgtgtgcaatccccagctctcctcgcccctccctncccaaactnccagcggccccccctgaccaagctccggggacggatggacggaggagccggctttccgggcacgcagccggtctcccgctcgcnggaggacgtcttcngggactacngcgcgcgccaggccggcctgatcagggcgctcaccaccgatgtggagaattctacgtgatgtgcgacccagagaaggagaattatgtttataggattctatgagacngggaanaaattgctg

SEQ ID NO: 5321 - DNA, 291 bp, Zea mays
  misc_feature: Incyte ID No: 700349954H1
  unsure 2, 11, 34, 59, 68, 91, 112, 116, 179, 186, 196, 204, 207, 220, 223,: a, t, c, g, or other
gngcaactctncatcctcactccccccactcgcncgcatcttccggtcttcctcatggngtcgagcgnccctcgccgagagcctcctaccncggcggcgggggcggagcatncgcntcaacatgacgaatacgaggagcgcgcgtacgactccgaggacaagatctccatcgccgtgtnggattcngaggcgaagngacggcangcnggatcgcgccgcnttntcgtggcggaagtctgcgctnnangngccggatttaccaaannannncntnncgncnnnccnaaatgc

SEQ ID NO: 5322 - DNA, 292 bp, Zea mays
  misc_feature: Incyte ID No: 700349955H1
  unsure 2, 20: a, t, c, g, or other
gnactcctagcctaccagangcagcttgccctgagccaggccgcggccgggcagcagcatgctggtcttgcgggccaggtttctgcagcaggccttcttgctgctgccggttcccaggccctctacgacggctacccgaatcagtcgtcagcgcagcagcttatgtactacaactagtagagctcaagaggaaggaaggcgtctgtagtgttcagcttgtttttgcgcaacttgggtcatctcgcctgtttttttcttatatttgtggttcagtactattgtgagagctctc

SEQ ID NO: 5323 - DNA, 299 bp, Zea mays
  misc_feature: Incyte ID No: 700349959H1
  unsure 2, 81, 88, 204, 211, 287: a, t, c, g, or other
gnaccaccacgggccacggcaatacggcatcatctccaaactcccgaggggggaccatcaccgctgctgagcacgcccgcngcctgcncttcctcctcccacccgtgccgcagctttcgattcctgcccgcctcattgctacctggtcgggccgcggaattaatgtcgcgcggaggaaatccggtaagctccggcccgattttnaactctncccctccctcatcctcgattggggttgagaattgaatcaaaccccccacacccacccacccaaaaagtcgccttcntcggacgagatc

SEQ ID NO: 5324 - DNA, 292 bp, Zea mays
  misc_feature: Incyte ID No: 700349960H1
  unsure 2, 27, 29, 38, 42, 45, 52, 138, 190, 242, 257, 264, 275, 279, 283, 290: a, t, c, g, or other
gnaaaacctacctagccgccgccgcangncccccaatncgcngcnaagatgnagatctttgtgaagactctgacggggaagaccatcactttggaggtggagtctccgacaccattgacaatgtgaaggccaagatcnaggacaaaggagggaatcccccccggaccagaagcggctcatcttcgccggnaagaagctcgaggacggtcgaacctcgccgactacaacattcgaaggatccncctccactggtgtcngcctccnggtgccccaanagcntaanaagaagnct

SEQ ID NO: 5325 - DNA, 296 bp, Zea mays
  misc_feature: Incyte ID No: 700349961H1
  unsure 33, 223, 226, 259, 282, 286-288, 290, 293: a, t, c, g, or other
cctttctagccttcacttctcagcacggcaggnttcgccgccccgactgcagccgccagccgcgccatggagcaagccgccatgccgcaggttccccgcgtacaagctcggcatccaggggcttgaggtgtcgaagctggggttcgggtgcatggggctcacgggcacctacaacgcgccgctcggcgacgaggccgtggcgccgtcgtcgcgcacgctttcngcngcgggatcacttcttcgacactccgatgcctanggccccgaacaaaggacacctcngagnnncncancaa

SEQ ID NO: 5326 - DNA, 291 bp, Zea mays
  misc_feature: Incyte ID No: 700349963H1
  unsure 209, 218, 220, 243, 272, 274, 285: a, t, c, g, or other
gcagatgttgacttccatatcgacagttgatgatctaaattaccctgaaaagacagagacctattatgtagtcaacgttccatacatattttctgcttgttggaaggtactatcagttacagccaacgctcggacctacggtttttagtaatttttttagcagaaaggaactgatgacgttaatttgagcatgccgctagttgtgaagncctctttcngngctactctgcataagacttcacnactagcggctgctcaattaacgtcacatncnttcagcatgangttaga

SEQ ID NO: 5327 - DNA, 294 bp, Zea mays
  misc_feature: Incyte ID No: 700349965H1
  unsure 75, 77, 81, 90, 92, 98, 113, 115, 117, 129, 139, 142, 284: a, t, c, g, or other
gtctccccttcccctcagtctctcacacgcacgctcctcccctacgcagcaaaaccctaaccctagctgcggacncngtcnccgcctccncncccaancgatgtctgattctnangngtccccaccgcncactccggcngcngcaacgcccgcagcgctggtgaagactccccgtcctcggcgaggaaggaagaatgctgcctgtggaggaaaagatctcggaattaagtgaatcacaatcagagttctagggaggctcgtgggctaaggaggattgctgaatngaggatatta

SEQ ID NO: 5328 - DNA, 285 bp, Zea mays
  misc_feature: Incyte ID No: 700349966H1
  unsure 261: a, t, c, g, or other
catggaaaggactgtgatatccaaagcaatgctgctatttgtatagaactgagcagtgaagaacctggaacatcatcacttgtttcacctcaggcagttggttctggtccatctatatcagaagatctcgtctttcggttactaaacctctcactgtataagatactggagaacaacctacaggaagcacaaattgctgcgagtaaagcatgaattggctcaggggatggtacgagcatgtatagagaacagctgcattcngcactggagctggagaatcactct

SEQ ID NO: 5329 - DNA, 284 bp, Zea mays
  misc_feature: Incyte ID No: 700349967H1
  unsure 16, 89-90, 95, 183, 188, 208, 251, 255-256, 265, 267, 271, 276, 279: a, t, c, g, or other
gtactgggcaaccgcnaccgccctccccctccgtcgggtcttcgccggcgccaccagcgacgactgggcggtctgtgtccctcttcgcnngagangatcacccaccaggtggatgtcgattttttggttgacaagttgaaggttacgaactactttgatcctgaggtgaagaagtaatgatcngcccngctcaagggatcgcaaattngataacataatcaaagattcatccgcaaccattgatgagaacngatnnaaaggggancntggnacatngancggag

SEQ ID NO: 5330 - DNA, 282 bp, Zea mays
  misc_feature: Incyte ID No: 700349969H1
  unsure 2, 102, 258, 264: a, t, c, g, or other
gnaaccctgctaacgatgacaacacgttcatagaagacaactcgttgccatcattctcaaaggctgttaatcagcgcgacgctgaccttgtctacttctggncagaagtaccggaaattggcagacagctcacatgagaaaaatgaagctcggagggagttgcttgaagtgatggcccacaggtctcatgttgacagcagtgttgagctcatggaagcctctcttggctcgaggagggtccaaggttctgaagcctcntgcagnggtgagctctctcgagat

SEQ ID NO: 5331 - DNA, 282 bp, Zea mays
  misc_feature: Incyte ID No: 700349973H1
  unsure 259, 267, 270, 274, 277, 279, 281: a, t, c, g, or other
ggtggacgaggtaagtgctgatgaggaagagcttttgggtttctggggatcctttgctgcctttatggagaagatgtggaaagtatcgagggagctggtgaatctggacaccacggcactggtcgctatagtgtcagggatcagcaatggcggggtagggaagctgatggctgcacctgaggcagagaccagagcaaggttcaagtgcaactaacaattctcaggatcagcacatacgaatgcatttccataccctagnttacgaanccntggnggnancna

SEQ ID NO: 5332 - DNA, 293 bp, Zea mays
  misc_feature: Incyte ID No: 700349974H1
  unsure 2, 288: a, t, c, g, or other
gnagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcataatccgtcacgtgttcaaggagtacctaccattcaccggtctggctgantcata

SEQ ID NO: 5333 - DNA, 285 bp, Zea mays
  misc_feature: Incyte ID No: 700349975H1
  unsure 31, 57, 208, 252, 254, 272: a, t, c, g, or other
tcttccgttctcaaaccaacctaggcaattngccgcagcctctcaccctcgcgagtnccgaccttcccgcagccgccgcacagatggcacccaaggcggagaagaagccggcggccaagaagcccgcggaggaggagcccgcgacagagaaggtggagaaggctccggcggggaagaagcccaaggccgagaagcgcttccggcgggnaatccaaggagggcgcgagggcaagaaggggaaaaagaggcganantcgtggagactacagatntaatttcaggtgt

SEQ ID NO: 5334 - DNA, 284 bp, Zea mays
  misc_feature: Incyte ID No: 700349976H1
  unsure 218, 237, 249, 261, 266, 275, 280: a, t, c, g, or other
gtgaaccttatcaaggaataccgtgcgaagatcgaggctgaactgagcaatatctgtgatggcatcctgaagctgcttgactcccacctagtgccttcttctactgctgctgaatcaaaggtctctacctcaagatgaagggtgactatgcacaggtatcttgcggaatttaagacggtcctgagaggaaggaatcgctgagagcacgatgatggccnacaaggctgcttcaggacntgcgcggcgagnggcactacccancgatnagcttgggntgccntaac

SEQ ID NO: 5335 - DNA, 285 bp, Zea mays
  misc_feature: Incyte ID No: 700349978H1
  unsure 265, 274: a, t, c, g, or other
ctgccctaaatgggtggtcaaggctatcgacaaaatcagaaggggctttttgtggaagggcagaaaagatgttagaggtggtcattgccttgtggggtggaataaggtctgtaaacccctaagtatggggggtttgggaattcacaatcttgaaattctggttgggcttgaatcgaggtggcgtggctcaagaaaactcaaccagacaggcctgggctgagtttgatgtgcaagtgccatcctaatgttacgccagttctcagcntcatttgcnccatataggga

SEQ ID NO: 5336 - DNA, 280 bp, Zea mays
  misc_feature: Incyte ID No: 700349987H1
  unsure 6, 132, 237, 275, 279: a, t, c, g, or other
ggaganaggaaaaaaaaagaaggggtaatctctggaaccatctagagacagcggcgcggcggtacgtggactggactggagcgagcaagcctgcgccggtgccgccgttcttcccgaagcagaagctgtagntggtcaagaattggggatcctgagttgaatatgatctcaaatccggtggactggtatagtttcggacccggatagaattggtagggatgcagattggagttcgangtaattcatgatgatttgcccacagcatagcaagaacntaang

SEQ ID NO: 5337 - DNA, 285 bp, Zea mays
  misc_feature: Incyte ID No: 700349988H1
  unsure 190, 202, 205, 215, 263, 281: a, t, c, g, or other
catcacgggcgcacaacaacacagcgacgctatctgaccgagtgttcaaataaatacccacacgggcacgccacgagacgatgagaccctctgctccaaatccgccgctcccactccaagttcacagggaggccagccatcgtagcctcgcccgactccgcttccctgttctttgggcatggagctgatnacaaatgtcacngantacgagaagntcgcgaggagaggctgccgaagatggtgtacgactactacgcttcggncagaagatcatggagctnagga

SEQ ID NO: 5338 - DNA, 279 bp, Zea mays
  misc_feature: Incyte ID No: 700349989H1
  unsure 52, 71-87, 172, 243, 263, 273, 275, 278: a, t, c, g, or other
cgacgccttacacccagtgccaaccgccgtgcccttcaccctctctatctgngccgtctctcactctctannnnnnnnnnnnnnnnnctacgccacgcaaaaagcgccacaagattcgcccctgctgaaaacgcactcgatggcgtccgcgacgggggtttcctcctcgganatggcggtggaccacgcgacggggccgggcgccgtggacaagccgcggttcgatgtctgacgccgattganatgagcggcgggaggcccanttccgaaaantnccnc

SEQ ID NO: 5339 - DNA, 283 bp, Zea mays
  misc_feature: Incyte ID No: 700349991H1
  unsure 209, 231, 252, 255, 270: a, t, c, g, or other
gtccctattaactgcattcactcactattatatcgataagggctatgacggtattgtgctcgagtcctggtcaagatgggctatttatggtgtgctggatgaccaagagctacgttacatggcacttgaatttgttaagcagctgggagaggttttgcattcagtcaattccaaaatcaagtagccaccatttggaattaatttatgtnattccagctccaggatgcaaanccccaataatagggatttggnccnaaagatctcagcacnggctgccacggaa

SEQ ID NO: 5340 - DNA, 276 bp, Zea mays
  misc_feature: Incyte ID No: 700349993H1
  unsure 2, 12, 31-32, 70-71, 75, 80, 124, 199, 240, 247-248, 253, 255-256, 261,: a, t, c, g, or other
gnatctgagtcnagtttatggacttctggcnncctccgcggctgtcgtgggtacgttcatatgaaatggnnagangcgangaagtttcaaagagagcaatgcatactgctgtatttatcctcanggctctttagccgcaactggtgcaacaagatctgcaaatattggaattgttattgccatggttctgttggccgcntatggggtggctattggaattctcaacagcacgaggtttanagcggcnncaagnannaaccnatacnnacaantngc

SEQ ID NO: 5341 - DNA, 281 bp, Zea mays
  misc_feature: Incyte ID No: 700349994H1
  unsure 185, 189, 206, 209, 238, 256, 260, 270, 277, 279: a, t, c, g, or other
gagaaacccgcagagggcgatagaggtcagcgcgattcggagatgggcatgggcgacgaactgtgggacgactcggcgctggtcgtcgccttcgaccgcgccatttccacgttacaatgaaatgcattgcaagagcaggcgagcaacgccaagtaaggatgcgaagaaggaacacgctgctgctnctgnagcagaagaagagcccntangctggagcatggatgatgcagagaggagngacaatgtgacaagcacngacnttgagcaacngcagccncnga

SEQ ID NO: 5342 - DNA, 96 bp, Zea mays
  misc_feature: Incyte ID No: 700349995H1
  unsure 13, 20, 27: a, t, c, g, or other
tgaaatgatgagngtataancttcttngcgtccaacactcatcatttcacatacatgacagttggacgcaaagaaggttatacaccagttagggtt

SEQ ID NO: 5343 - DNA, 200 bp, Zea mays
  misc_feature: Incyte ID No: 700350001H1
  unsure 177: a, t, c, g, or other
gcgttcggagtgctatgtttagtaacggtttgtgcttatatatgtttcatatgagtggtgagtgtcgtcgttgcttactttgtttcctgtcgatgttgtttgcatgtacatgcagtctacgttagtgagtgagtctatggctggaactggcgatcggccggacgacgtctggttttnccgccggtatgatcagcagaggc

SEQ ID NO: 5344 - DNA, 308 bp, Zea mays
  misc_feature: Incyte ID No: 700350002H1
  unsure 3: a, t, c, g, or other
ggnagaggtttgatgaatgcccgttatctcccttgtcactgaaaggtgttaaggctgctgggtatgaacagatgactgctgttcaggaggctactcttcctattatacttcaagggaaggatgtactagccaaagcaaagacaggaactggaaaaactgtagctttctgctaccagcaattgaagttgtttcgaaattgccacctgttgatcgtgatctaaagaaacctcccatcagtgttgtagtagtgtgccctacagtgagcttgctgatcaggctgctgcagagctaacaagcttctaaatttc

SEQ ID NO: 5345 - DNA, 294 bp, Zea mays
  misc_feature: Incyte ID No: 700350004H1
  unsure 3, 9, 17, 25, 33, 121, 124, 181, 185, 190, 194, 198, 212-213, 252, 289: a, t, c, g, or other
ggncaatanagtgatcntctaaggntttttgantatggaggttttcctcctgaagctaattatctattcttaggtgattatgttgatcgaggcaaacaaagtttggagactatatgcctcntcntgcttacaaaatcaagtaccctgagaacttttttctctgaggggcaatcatgaatgngccncaatnaacngaanataggatttatgannaatgcaagcgtcgatttaatgtgcggctatggaaggtcntcacgaatgttttaacactctaccgtggctgcactancgtga

SEQ ID NO: 5346 - DNA, 297 bp, Zea mays
  misc_feature: Incyte ID No: 700350005H1
  unsure 264, 286: a, t, c, g, or other
agtgccactcgctggagcggctcgaaatcactggctgccctatgatcacggacaagggcctcgtcgctgtggctcagggttgcccggaactgaagtcgctcaccatcgaggcctgctccggcgtggctaacgagggtctcaaggcaattggccggtgctgcgccaagctacaggcggttagcgtcaagaactgcgcacatgtcgacgaccagggtgtgtctggcctcgtctgctctgcgacagcctcgttggcaaaggtccggntcaggtttgaacatcatgatgntctctcgcctg

SEQ ID NO: 5347 - DNA, 293 bp, Zea mays
  misc_feature: Incyte ID No: 700350007H1
  unsure 52: a, t, c, g, or other
gtttgctacaccaccacacccacaccccatcccagcacacaacaagcagccnggtttacggtagctgctagcaaaacaatggagaaccctgctccgagcatcgtagtggccatcgccgcacccgtggcggcggagttcgtgaaactcaccttccgtgccctgtatatgcgccgggctggtctggcagcagggagatgactgtgccgggaaggccatccgaccagctgggcaggagagtcttcatgacagccccgtgtacgacggcctggcgccgacgcccgcctctggctcgc

SEQ ID NO: 5348 - DNA, 295 bp, Zea mays
  misc_feature: Incyte ID No: 700350008H1
  unsure 2, 106, 120, 163: a, t, c, g, or other
antcgatccatcgcctcgccgcagcacacacgaggccggcggcgccatggccatgaagctggacatgtccgcgctcgagaccaacttcgccaacctgaccgcctcngccggcgacgacangtacttctccgccgaggcccccgacgtgccgtccatggtgctncccatctgcgacgacttcgacggcttccaggcggccaccaaggatatggtgaagaataagaaggggacgaccacgcttgccttcatcttcgacaaggcgtcatctcgccgctgatccaggccagcatgggcg

SEQ ID NO: 5349 - DNA, 294 bp, Zea mays
  misc_feature: Incyte ID No: 700350010H1
  unsure 246: a, t, c, g, or other
gcttcccgtgcagcgccctccctctacgttcccccatttcctgtgttggcggcgatggcgcggcacttcgtgcttcaacaccggcgccaagatcccctccgtggggctcggcacctggcagtctgaccccggcgtcgttggcaacgctgtctacgccgccgtcaaggcggttaccgacatatcgattgtgccagagtttacggcaacgaaaaggagattggtttggcgctgaagaagctattgaangagggtgtagtgaagcgagaagatctgtttatcacctctaagctagga

SEQ ID NO: 5350 - DNA, 290 bp, Zea mays
  misc_feature: Incyte ID No: 700350011H1
  unsure 21, 23, 25, 28-29, 31-32, 39, 83, 85, 116, 121, 124, 131, 166, 175, 177,: a, t, c, g, or other
acactaaaccccccctgcccnanangtnncnngtacggncatgaaaccctagtgagtagtgaccctgtccggatcactgagtngngccgccatggcaccctgccgctctggcctcnctccnggngccgctncggtcactgcggctgcaagacgaagcagcaggagntactgctcngngtctnggngtggcgctncatctacgttctcgccttcgccgtcngcntcttctccgtcctccgctagagtctatgatccagattcgacccctattcantaccgcaccagncttc

SEQ ID NO: 5351 - DNA, 291 bp, Zea mays
  misc_feature: Incyte ID No: 700350012H1
agcaaaatgctacaaacaaattgcgtagtggcaacggattgggtctggccctttccagaagatttgttgcccttatgcaagggaacatctggctggaaagcgaaggcgtagggaagggctgtaccgcaacgttctttgtgaagctaggactatctgatgcaaatctccggaggatggtgcctcctgtccagccaaaacatggaaatggcagatccagatgtatcatcaataatcaacggcgacatggcgattctccgcgttgttaccatcgatgatatgacaaggaatgca

SEQ ID NO: 5352 - DNA, 209 bp, Zea mays
  misc_feature: Incyte ID No: 700350013H1
  unsure 13, 41: a, t, c, g, or other
gtagccgtctgcntcctcgctttccctttcgtccgtacgcngccgcctcgcaccgccgacagttcctcagttccagaacttccagatcgagcctccctctaccccagatcgggtcctaggctacagcagccgccgcatccgtcaccttcacaccgcgtgcgtgctctctctcccccctgcccctctccgtgcgacgactgggtgggcta

SEQ ID NO: 5353 - DNA, 297 bp, Zea mays
  misc_feature: Incyte ID No: 700350014H1
  unsure 2, 270: a, t, c, g, or other
gnaggacatggaagatgcaaatacagtacctcactagacactaggatgatgagctccaccttgccgtggccgagttgttcaacggaatgacatgccgggaagtggcagcctcgctgcaccgattcgcttgccaagtttatcgtgcctgacaacccagagaaaatcctgtcgcttgtcgctgccaaggctagccatcatagagctcttggctctgcggaccttcacatgtgaccctgcaggcatgcaggggcgaggcaaccgatggccgcntgtgctggagatccagcgacatcatct

SEQ ID NO: 5354 - DNA, 174 bp, Zea mays
  misc_feature: Incyte ID No: 700350016H1
  unsure 2, 28-30, 88, 123, 132, 135, 137, 147, 149, 169: a, t, c, g, or other
gnggagggggtccaggccgcttgttctnnnccgcgtacggttcttccaagaacccgcggcggggatggatctctacgatgagggagangagatggccttacaagacggggactcctgcctcgngccacgggnttngnggggcagatncnaggtggacttgcagtgggcngatgc

SEQ ID NO: 5355 - DNA, 291 bp, Zea mays
  misc_feature: Incyte ID No: 700350018H1
  unsure 31, 268, 275: a, t, c, g, or other
gtcgccttcatgaaggacttccaagccaggnacccttgattgcctcgtgcttatgatcatttggtattgctactcagtctttcttcctagcataagtgagctcgtgcaagagctgtctcgcgttgcgcactgggatctatctgtagtattagtaccataacgtaacggctactgtattttgcaatgtttttttttctctctcgctttgttaggtgttcaggaatttcattctatgtatcaccatgcattgtaagtgtttttgcggaantaaggantaggtagaggccgttg

SEQ ID NO: 5356 - DNA, 291 bp, Zea mays
  misc_feature: Incyte ID No: 700350019H1
  unsure 98, 189, 191, 286: a, t, c, g, or other
tcaaacagcagaagggagaagagaagcacgcccaaaaattccaaggtttttcacctcttggagcgcaccaacaccacccggagaccggagcgactcangtccggcgcggaaaaggagggcggaggctcgatggcggatgagaatcaggctggaaagaaagaggaggaggaatttagcacaggccctctngnctcctaatgatgagtgttaagaacaacacccagtcctcatcattgccgcaacaacagaagctattggcctgttctgctttgatcgccatgtaacnggtgc

SEQ ID NO: 5357 - DNA, 296 bp, Zea mays
  misc_feature: Incyte ID No: 700350021H1
  unsure 34, 95, 192, 291: a, t, c, g, or other
gggaaaacgcattcacatcttctcttcgtccgcngccgccgcctctcttcattggtagcaccttaatccgaccccagtcccagccccccgccatngaggcgctgacggccacggacaaatgcttctccccggccagggcgatgttcccgatgccgattgtgaggccacctgcatcaccagaccatgccagtncagtatctggaggacttgttgcaggagcaacagaagctcgggccatcgtgcaggtgctcccaatctgcggcagctgttgaatcaagagatatgagaacntcaaa

SEQ ID NO: 5358 - DNA, 293 bp, Zea mays
  misc_feature: Incyte ID No: 700350022H1
  unsure 45, 47, 116, 143, 183, 185, 240: a, t, c, g, or other
gttcgcttcaactcccactcccactctccctttcaactctcaggntnccactccccccctaccggctaccctacccatcacacacaaacagccactcctcacctcccccgtcctcnggttcatgtcctgctgctccccatgtngcccccactcgacctcgactacataggcctctcgccggcngngctgccgcggtgcccacgacgacctgaagggtaccgagctccgccttggtctgcnggggtccggttcgccggaccgccgtgttgtggctgccaccgcaaccacctgga

SEQ ID NO: 5359 - DNA, 282 bp, Zea mays
  misc_feature: Incyte ID No: 700350024H1
  unsure 44, 150, 262, 267: a, t, c, g, or other
ttgagctcgcaacttctcttattgagaaggcgaaggcaaagggngtttctcttttgcttcccactgatattgtagtagcggacaagtttgcagccgatgctgagagcaagattgtccctggccactgctatccctgatgactggatgggnctgatgttggcccgatgccacgaaaaccttcaacgaagcatggacaccaccaagacgttattggaacggccccagggagtgtttgagttcgagaatttggcagtgggaatgnggcgntgccaagaagctagc

SEQ ID NO: 5360 - DNA, 286 bp, Zea mays
  misc_feature: Incyte ID No: 700350025H1
  unsure 2, 251: a, t, c, g, or other
gngatcacgcgcgtcacccgaaagggaatcgggttaagatttcccgagccgggacgtggcggcagacggcgagagcggtctgcacggcggggcctgcgccgactacatggtcgtcgccacaggccgctccgattggcacgtccgtaacatcgcgcaggcgctcctctacaagataaagcaaaagcagaagggctctgatagaatattgatgccaagtgtagaaggtcagcaagcgggaaaatgggttgtcntgattctggaagcataatcatccagcattgaagaa

SEQ ID NO: 5361 - DNA, 289 bp, Zea mays
  misc_feature: Incyte ID No: 700350026H1
  unsure 24: a, t, c, g, or other
gggcgtgctgggcatcgcctgggnccttcggcggcatgatcttcgtcctcgtctactgcaccgccggcatctccggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcacggcctcggcgccga

SEQ ID NO: 5362 - DNA, 289 bp, Zea mays
  misc_feature: Incyte ID No: 700350027H1
  unsure 75: a, t, c, g, or other
gtgaggctaaccaccgcagcagctgcgacctgcgagtgcgacaacctccgcggaggagttggagccggcggcggnggatatttgcttgcccggctggggttgcggcggaaggagggagagacaaccggcgatggcggcgtccgcgaggcccggggagagggcgacaagcttcgccgttcgcgtgcagcctcctcagccgctttgtccgccagaacgcgtcgcggctgccgagctaggccttcaggatcaaaggcgaggtcgagcagcagaggacgccggcgcacaatta

SEQ ID NO: 5363 - DNA, 283 bp, Zea mays
  misc_feature: Incyte ID No: 700350030H1
  unsure 2, 272: a, t, c, g, or other
gnttctggcaagcattattgcaggatctgctttagagcagctaaaaagctatattcatcagtcagcaaatgagtatgtctttggctagccttttatgtcatgccattcatcattctcatccttgtattgtgtactgatacattatagagatgcattaaataattacaagttggggaattattcatcatctatcccattggctgatgaaaagatttgggataatcatagagatgcataacataatgcttgagataaatatatttaagataganatattatcatc

SEQ ID NO: 5364 - DNA, 287 bp, Zea mays
  misc_feature: Incyte ID No: 700350031H1
  unsure 2, 15, 261, 273: a, t, c, g, or other
gngcccgcgcccgcncccgcgccactccacatcgtgatcgagacgacccgcgtcctccgcggtccgcgcccgtgcaccatctcgcctcgcattcccgaaagtatctgtattccttgatcaacatgttcgcgggaggagaatgtttatatggccaagctggctgagcaagcagaacggtacgaggaaatggttgaatacatggagaaggtggctaagaccacagatgtgcaagagctcatgttgaggagcgtaacttctacngttgcctcagangtgattgcggcccc

SEQ ID NO: 5365 - DNA, 290 bp, Zea mays
  misc_feature: Incyte ID No: 700350033H1
  unsure 180-181: a, t, c, g, or other
gtgtacctgtacgtcaacatcaggatgctgatggcatgttatctgaagatttactgaagcgtcaatcagctgaagatcctgatggaagtttctacactggggatgatcctgatgtaagcttttataacggggatgatcttgatagaagctctacaatggagatgatcctgatagaagctnntacgatagagatgatactgattatattgagggaagcgatgatggaccaccaaggaagagttctgaagatatgtacagttaagaactcaaatggcttgcagtagagaatc

SEQ ID NO: 5366 - DNA, 290 bp, Zea mays
  misc_feature: Incyte ID No: 700350034H1
  unsure 288: a, t, c, g, or other
gttaacatcagcagcatgctgggtcgcatggccaacccagcccgctcaccatactgcatcaccaagtttggggtagaggctttctcggactgcctacgctatgagatgcaccctctgggtgtgaaggtcagtgtggtggagcctggcaacttcatagctgccaccagcctctatagccctgagcgtatccaggccattgccaagaagatgtgggatgagctgccagaggtcgtccgcaaagactatggcaagaagtattcgatgaaaagatgccaagatggagactangc

SEQ ID NO: 5367 - DNA, 288 bp, Zea mays
  misc_feature: Incyte ID No: 700350035H1
gttggtctttgctttgtggtggatggctttccaccactcgctgaattcactgaggtgcttgctaagatctatgagaaactcaaagaagtgggagagaaatttgaagttgtagctgtatccttggacagtgaagagtcatcatttaatgagagttttgcaaagatgccttggcttgcaattcctcaaggtgacattaagtgtcagacgctggttcgttacttgagctagttctctccaacactagttctgattggccctgatgggaagacactgaacaacaatgtcgcc

SEQ ID NO: 5368 - DNA, 283 bp, Zea mays
  misc_feature: Incyte ID No: 700350036H1
  unsure 110, 230-231, 276: a, t, c, g, or other
gtttcgtctagtcttcaaggaagaccggaaccgagccgccctgcccgaggacttgagccaccggacgcacggctgctgccgaaatccacgggagaatgacgatggccgangccgaggctggtagggcggcgatccggcgcgccctgcggtcgctgaaacggaggcatctcgccgaggaaggggcgcacagcccggccatcgaggcgctaacccgtcccttcgccgcccannctttggatggaagagaaggctgaaaagcagattagagtgcagcangctacaa

SEQ ID NO: 5369 - DNA, 280 bp, Zea mays
  misc_feature: Incyte ID No: 700350037H1
  unsure 2: a, t, c, g, or other
gngcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggttctctcgcgaactcgacaccctaccttggcggaatactccggtgatcgtcctgcaggctgggtgcgtaaggtccctcgaccgcattctctcc

SEQ ID NO: 5370 - DNA, 284 bp, Zea mays
  misc_feature: Incyte ID No: 700350038H1
  unsure 177, 217, 226, 268, 277: a, t, c, g, or other
tgaacatgaagcagcctctgcgtgctgcccgcgcaccggtcgccccaggaccaggaaggaccccgaggcggaggtgcgccatgggcacaactacgtgccccgcgacgagcagttctcggaggtcaagcagctcacgttcggggccacgacgctgcgctcgggctgcacgcgctgctncccggccatcaggcgatgctcattcaagagggagctgcgnttcccgcanttcccggccttcgacgactctacagcgaggcatcccgctgcngcgcagacnggttggg

SEQ ID NO: 5371 - DNA, 281 bp, Zea mays
  misc_feature: Incyte ID No: 700350039H1
  unsure 2, 36-37, 87, 121, 267, 273, 275, 277: a, t, c, g, or other
gngcatggacgtcgtcaaggccatcgagaaggtggnnacccgcaacggctccaccttccaaggtggtcaaggtcgctgactgcggancagctctcctagatctctctgatctggtctgttncggccgccctccctccgtcatcgtcgactccccctggcgtccgtttcctttggatctgaataagatggtggtgatctgagtggtggtcttagtttatcagtatcgctcgcatttaattagcggtttagtgtggatcgtgaaccccnggcgcntngntgat

SEQ ID NO: 5372 - DNA, 284 bp, Zea mays
  misc_feature: Incyte ID No: 700350040H1
  unsure 272: a, t, c, g, or other
tttcccgtttcccccgttcagttcagcttcggttggctcgccgtactcgggtttgttcctcgcctcgcttcgctttccttcctccgcagtcctcgtctcgaattcgctcgcggtgggagaaatcggggcgcgaggatgaccgtgatcgacatcctcacccgggtggacgcgatctgccagaagtacgacaggtacgacgttcgacaagcttcaacggcgcgaacgttcgccggcgagacccgttcgcccgcctctacgcgttcgttcgacgngacatcaaccaa

SEQ ID NO: 5373 - DNA, 281 bp, Zea mays
  misc_feature: Incyte ID No: 700350041H1
  unsure 2: a, t, c, g, or other
gngctctccgcaacttgggagttcaaacccccccgcgcgcgctcggacctgtgtctacaagcttctggatccgtccctggcgccgatggagcggttcgactccaagttccacgagaagtacactgttctcaagaagaggaagctgctagacgaggggctagagcgaaagcgaggaggcggagttcaaggagctttacgatgccatgaaagattgggtcagcgaatcaagaaagacaatgcggacttcaacgataagctaatggaaaagcagatgagctcga

SEQ ID NO: 5374 - DNA, 277 bp, Zea mays
  misc_feature: Incyte ID No: 700350042H1
  unsure 23: a, t, c, g, or other
gtctctctcgcccttctcccgtntccgctccgcctccgcgcgtccggcgagaccgcgagagcgagacgatgggaatgctacaaattccccttctgagtccgaccctcctcatccaatagtaccacctgctcgctgctccgccaccgctctcgctcgatcgcccccctcgttcgtcggccttcgcttccagacctccgagtcctcaatctgcagctttggtaattggtcgtatagtccctcatcatcggaaggtggggtcattatcttcccacaccta

SEQ ID NO: 5375 - DNA, 276 bp, Zea mays
  misc_feature: Incyte ID No: 700350046H1
  unsure 14, 215, 219, 259, 267: a, t, c, g, or other
ccgttccgccggcncgcccgtacccgcctgcgcctacacatcgctgctccaggtccccatggcgaagatacgcaacccaccgcggggatgcgggatcccctgctccccacctccaccgccgccttcaccgccgccctacctcgacccgcatcccgccgactcctacacctacacggtcctccttgtccccgttcgcctccaccgcggcctctgtngcgnggccgttgcatcgtcccctgctcacgttctctttcttctngcgctcgnggtttctct

SEQ ID NO: 5376 - DNA, 283 bp, Zea mays
  misc_feature: Incyte ID No: 700350047H1
  unsure 2, 162, 174: a, t, c, g, or other
tnggagcaaggggagtagcggaggatggagattgaccaggcggtgcgcgggtgcagcgaccgccgcatgcgcaccaagtacagcaacgccgtctacgtcgtccagcgggccttcgcgctctacccatttgaggaagttgccttcagctttaatggtgggaangatcaactgtgnctcctgcattgattcgagctggttactacctttacaagaaggactctggtgatgtagccccaaacagatgctgttaaaaactgtccatggtactatctatttcgaaagc

SEQ ID NO: 5377 - DNA, 298 bp, Zea mays
  misc_feature: Incyte ID No: 700350049H1
  unsure 2, 218, 225, 238, 250, 266, 269: a, t, c, g, or other
cnatgacattcttgctcaggtttcaacgaaaaccgagtcaaataagaatgctggaaatgctattttatatgaatgtgtggagacaataatgagcattgaagctacaagtggtttacgtgtgttggcaattaatattttgggccggtttttgtccaaccgcgataacaacataagatatgttgccctaaacatgcttatgaaaggccattgccgtagancacacangcggtgcagaggnacagggcaacantattagagtgtgtcanggntgcaagatgtttcaattcgtaaaagggcc

SEQ ID NO: 5378 - DNA, 274 bp, Zea mays
  misc_feature: Incyte ID No: 700350051H1
  unsure 80, 253: a, t, c, g, or other
gggcctaaactttgacggcgatgacagggttcactattagcatctcatctctttgggaccttggcagggagggtgcattncgtcaaggcccctcgccgacatggcctatgtaccacgggcggctagacaataaagatgtctgggtgagtgagccgagcatagacaatggctatgctgctttagcctcccttccctgtacaggtttgccattgtttggttgcgcggcgtcctgtgtatttgagttgagatcacnttgctgcgagtgcgtagctgc

SEQ ID NO: 5379 - DNA, 291 bp, Zea mays
  misc_feature: Incyte ID No: 700350052H1
  unsure 289: a, t, c, g, or other
ggccagtccccaatccccatccagccagaccgccggcgatgacggaccaccgcgacgtgatgttgcccttgtccctccaatacatagccacccgtgccctcctcctgctcgtcatcgcgtccgccgtttcctgctcttccttgccgccggaggacggcatccgggtcgtctctgcagagaaaagaatcgacctcacgggtcccatcgtcaaagtcttcctaacattgaaggttgagaatgctcccagggcctctgaagcatcacgagttctcctcgcttcaggccaaanga

SEQ ID NO: 5380 - DNA, 287 bp, Zea mays
  misc_feature: Incyte ID No: 700350053H1
  unsure 11, 161: a, t, c, g, or other
gcgaagaagcnggcttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagantcatccaggaggacatcattgagacagtcaacaaccatcccagtgctgggtggacagcctcacgtaatccttacttttcaaactataccattgcgcaatttaagcacatacttggagtgaaaccag

SEQ ID NO: 5381 - DNA, 283 bp, Zea mays
  misc_feature: Incyte ID No: 700350055H1
  unsure 250: a, t, c, g, or other
caaactagtctctggtgtgcattagaggatcctgcaaaatatctgatcacgttcatggcattttccagaaatggcaacacttattgcaccaagcatatgcaacttaccttccacaggcatggagaggtgcatttgttctgtctttgtatggttcctcagaggtggaaaaccaacttcatgctaaagctatgaccaaactagatgccctcaatgttgatcgcgacaggatatcggcattcgataaggttcntcatggggactgatggactaggagtaatgggtc

SEQ ID NO: 5382 - DNA, 283 bp, Zea mays
  misc_feature: Incyte ID No: 700350057H1
  unsure 75: a, t, c, g, or other
tagctccattaggtggcatgccaatgaaattcacagaagcgccactaactgcttcaaagaagaaccctgttagtncgtccatcaaagcctgttgggccacctccaggatttgatcatgtagccccaaagcgccaagatgattctattccagttgaaaaactgcagatcccacaggttgatgattacagctggctagatggttatcagcaatcgattgatcatgttcacaacttaagaatgtttattctggtgtcatgacagcactgcattgccatccatccct

SEQ ID NO: 5383 - DNA, 288 bp, Zea mays
  misc_feature: Incyte ID No: 700350058H1
  unsure 11, 118, 191, 263: a, t, c, g, or other
gccagtgagtnacacgtcagggagtgccagcacggaggaaggccgagggaaagttacagcactcttgaagcagaaaggtgttgatgtcaaaggaatctcaaaaactagtgtgccagtnaatgacgaagttcctcctttgctggatggcggtggaaagcttgaggtttggtgtattgatggcagtgccaagnactgctacttccaaaggaagaacttggaaaattctacagcggagactgctatgttgttctctacacttatcntctgctgacaaaaagaagagttcta

SEQ ID NO: 5384 - DNA, 286 bp, Zea mays
  misc_feature: Incyte ID No: 700350060H1
  unsure 2, 283: a, t, c, g, or other
gnctaccgttcggggtggtggcatccgggattcgtccacacccaggcacataaaagccgcctctcgccgccgactgcaaaccctcgtttttctctctcctgcgctgcgccgtccttcacctccgccgccgaatcccgagactctgatctcgggttcaccgcagcgcacagagcacccccgactcccgttcccgatccgcgctctcctctacgacgcttcagtcatggcaggaatggcacccgaggttctcatttgatgctaagcatatgattctaaaatgcangag

SEQ ID NO: 5385 - DNA, 292 bp, Zea mays
  misc_feature: Incyte ID No: 700350063H1
  unsure 2, 14, 46, 48, 50, 57, 64, 70, 100, 125, 132, 135, 178, 216, 221, 230, 247,: a, t, c, g, or other
gngcgcttccaaangccgccgcgattcggcatcctgctcgcgtganangngctcatnccagctnccaacngcgacatgctaccgccccgcttcgcctttntttcccgtacgcttccttcctccgntgctccngcngcccttcctccggcaggattcgacggcggcggcggtctctgcnagcctcctctcacttcacggctgcctggagggcttccngagcngcggcgatntctcacagctacgcttncctcgtcatcctgcaccgctgnggcntcccgcgcngtcgagagtg

SEQ ID NO: 5386 - DNA, 282 bp, Zea mays
  misc_feature: Incyte ID No: 700350064H1
  unsure 2: a, t, c, g, or other
cnatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcataggaacctaggaaccaagtgtcgtctccatgagctttcaaacaagcgaa

SEQ ID NO: 5387 - DNA, 290 bp, Zea mays
  misc_feature: Incyte ID No: 700350065H1
  unsure 124: a, t, c, g, or other
ggtcaaggaagtgcctgaagttgctcccatgagttcagagcctgaggttgagaagtggacatcagttgagattgatagagcctagatttaacaaagtctggagtccctgtggaagatatgcagngcaaagtctgtttcaacaagcttgaagatgattctctgcgactgcaggtccatgtctgactgggagttcaattgcagcttcatcctataatctgatcagacatcaaaaccaacgtagcttctactgtgacatccattcctgatggtcgctacgaagtggcaccttc

SEQ ID NO: 5388 - DNA, 250 bp, Zea mays
  misc_feature: Incyte ID No: 700350066H1
  unsure 16-17, 31, 45, 66-67, 115-133: a, t, c, g, or other
ctgggagaagaggaannagaggggaggggcnacaaaaagggcgcngcgccacgcatcgcccccganncccggcatctctccctcgctctccttctcccgatctgatccgaagcgnnnnnnnnnnnnnnnnnnnctaagggcacgatgcattcgaccaacctgctgctggaggagcccatccggatggcctccatcctggagccattccaagaccagcttcttcccggcgatgaccagatcgtcggcacgc

SEQ ID NO: 5389 - DNA, 287 bp, Zea mays
  misc_feature: Incyte ID No: 700350067H1
  unsure 142, 219, 267, 271, 278: a, t, c, g, or other
gtcgatcgatcccttctaggggaggggaattcaggacaggaggaggccaggttctcgccccgcaataggacgccgatcgattccggatcttagctcgagagtcccggtgcccccttctcggtgctcgttgcaggattttcgnggtagtccaaagaaataagaaacatggccagagacttatgttgatgagcaaccaaagggtgtgtctcggaatcgtcnacctggcacatatgaatggtgatgaagaaaaggtttatctggccaatncccntgttgantgggaacaa

SEQ ID NO: 5390 - DNA, 281 bp, Zea mays
  misc_feature: Incyte ID No: 700350068H1
  unsure 168, 240: a, t, c, g, or other
ttttggaactgccttgcagggtgctggaccaggattgatccgtactgggctagaaacatatggcggaaggattttagattcaagttctgagtttatgcagagcaatataacacaatatttgtgccgaccctcagtactactttcaagtcaacagccagtatgtgaggnacaaactgaaggtcatctgttcccttcttgcacaggggtcatggaccagataactggaaccattggaggaangctatcctacaaacctccgttccaggatatcaaggcccggg

SEQ ID NO: 5391 - DNA, 280 bp, Zea mays
  misc_feature: Incyte ID No: 700350069H1
  unsure 37, 77, 262: a, t, c, g, or other
ggctcgttgtctgacaagatggatgaacttgcttgcnttgctcctggtatgctggccttaggtgcctctggttacgngccagaaaaatcagagcaaattatgaatcttgcaaaagagcttgctaggacctgctataatttctaccaaaccactcccacgaagttggctggagaaaattatttttttccatactggacaggacatgggtgtgggcacgtcgtggaacatctgagaccggagactgttgaatcactgatgtacngtggcgtttgacgggaat

SEQ ID NO: 5392 - DNA, 275 bp, Zea mays
  misc_feature: Incyte ID No: 700350070H1
  unsure 26, 32, 127, 183, 209, 216, 223, 226, 253: a, t, c, g, or other
gaattaagggaccgagaaatggagcntaaggntcaaattacagccattattgacaagagcaaggaaatgattaaagcagagactgaatctggtgaagtcggtccgcttgttactgaggcagacattncaacatattgtctcctctggactggattccgtggagaaagtgtcatcggatgagtncgaccgcctcctaaagatggaagagnacgcgcntacactntcntggacaggatgaggctgtcaaagctantagcctgctatccgcctgctct

SEQ ID NO: 5393 - DNA, 280 bp, Zea mays
  misc_feature: Incyte ID No: 700350072H1
  unsure 59, 69: a, t, c, g, or other
gtcatatctgaagggatttactgatggaacaatgattgtaggtgagttcagtggtaganaggttcaggnagcgaaaccgctgattaaaagtaagcttttggaagaaggcacagctgtgttgtatagtgagccggagaagaaggtcatgtctagatctggtgatgaatgtgttgttgccctcactgatcagtggtatataacttatggcgaggctgaatggaagcagaaggcagtcaaatgtttggaccgcatgaatacatctcaactgaaacccgcaatg

SEQ ID NO: 5394 - DNA, 165 bp, Zea mays
  misc_feature: Incyte ID No: 700350074H1
  unsure 29, 42-43, 46, 60, 64, 75, 92, 94-95, 115, 133, 138, 142, 145: a, t, c, g, or other
ttcttcgtagcgccgacgctccatcttcngctccctcccatnnttngcgctcggcacgcnggtnacggcggcagnagcggcgctcaggatcngnnctctcagcgacggcatcagnggtttcccctcccgcttntatcnagtngcntcgagccctcgcctcgggtc

SEQ ID NO: 5395 - DNA, 163 bp, Zea mays
  misc_feature: Incyte ID No: 700350075H1
  unsure 102, 106, 110-111, 116, 120, 127, 131-132, 134, 137, 144, 151, 155: a, t, c, g, or other
ggcgaaaccaaattataacttggttatgtactacgctgccagagagaccagtgaacaaagattcttgttgggtagattcattgatggaactgatgcataccnggangccnngtttnaacntattccnagcnntngtnaagggtnatggganggtnaaccgtcc

SEQ ID NO: 5396 - DNA, 278 bp, Zea mays
  misc_feature: Incyte ID No: 700350077H1
  unsure 77, 244, 266: a, t, c, g, or other
gttattatgtatattataaaaagaaaacattatcgaatttggtggtgaagtcacaattacattttttgttttgtatncagtaccgaggttttggctttgtattttcaaaacaaacacatacctattatacctactaacattagttgctacctattagtgtttctctattaaataagttcgatcactaagtttggtcaatcggttgtataatttcttattaatataacaccagacaatgaaaggngcctatctaggagtgattctcnggataggtcacc

SEQ ID NO: 5397 - DNA, 279 bp, Zea mays
  misc_feature: Incyte ID No: 700350078H1
  unsure 10, 12, 185-186, 204, 253, 274, 278: a, t, c, g, or other
ggttcctaangncctagtttggaaaccccattttccccacgggtttttcattttcccaagggaagttagaacattttccccttgggaaaatagaaatcctttgggaaaatcgagttcccaaactagccctaagtgtgcttaaagccttaaaaaagcctgctgagttttcctgaatggtgtatganntaatgagatgggttcatnggtttactcccttggccatggtgatgatttgaatacataatatttgttntcatattagttgcagtgaggntcant

SEQ ID NO: 5398 - DNA, 272 bp, Zea mays
  misc_feature: Incyte ID No: 700350079H1
  unsure 105: a, t, c, g, or other
tgatgaagtcccatgctaagagcaatgctctacttgaagtagaatataaagaggaagtgggcactggtttaggtcctacaatggaattctatacattgataagtncatgaatttcagaagtctggtctaggcatgtggagaggggaacttcctgtaaatacggtacccatgatactgcatgtttctagatttgtggttgcctctaatggactttccctagacctggtcgcttctgaagatccgctccttgcaagaagtgagcgagcgatcca

SEQ ID NO: 5399 - DNA, 279 bp, Zea mays
  misc_feature: Incyte ID No: 700350080H1
  unsure 2, 89: a, t, c, g, or other
gnacgcatgggagttcgccatcaccaggaagttcgccggaggggacgccgtcaagggcacctaccaggcctccaccaagctgctcggcntcgagtggagcagggactctctcgccggcggctccttcaaggttgcgacgacattcgatttgtcggaccaaagcaaagcaccaaagctaatagcagagagcacgtggaactacgaaatatgaaaaatggaagtgtccttctcatatccatacatactgcttgattgctgtatcctcctgaactatggagc

SEQ ID NO: 5400 - DNA, 281 bp, Zea mays
  misc_feature: Incyte ID No: 700350081H1
  unsure 248: a, t, c, g, or other
agctcgcaccgcggttgaacagcgtttcgttgtttcctccccaacttccaacacgcctcgatctagatccactcttcccccttctccttccggtcctccccccgagactattcatataggcgggtaggcgtccgaggcctcgtttgttctcggcttcttgtctccaagggtgctactccgtccgcgcttggtctgctctcgtccttccggaggccgcggcgcaacatggcgaagatcaagccgaaggnttgctcgcgcaaagcaaggtgaagaaggtcccc

SEQ ID NO: 5401 - DNA, 278 bp, Zea mays
  misc_feature: Incyte ID No: 700350082H1
  unsure 62, 73-77, 82, 123, 271: a, t, c, g, or other
ataatctgcgttgctatgaactttcatcagagctaagtagcagtacattggaggcgcttccncacaactttgnnnnnccggntaattttgaagacacctgcaaaggatttcttgaggttgccntggaggccgtcctccaaactgttagtgttatttttgaagacccaggtgtgcaggatctactcgtgaagcttaccagaaagactggctggagggaatggtcacagaatatcttgtcgcaacatttgctgattactttggtgatgttaanaagtata

SEQ ID NO: 5402 - DNA, 284 bp, Zea mays
  misc_feature: Incyte ID No: 700350083H1
  unsure 116, 217: a, t, c, g, or other
ggaatcgagtctgaagcacagagccatcagagactgaccagagccgagaccaaggatcctgtactcctgtgcactccggcggccggaaccacggcgagtaccgggacgtagaagtncgccccgcccctccggatgcgtgttgctgcgggaaattgcttccgagtagttcccgacgccgcgggcctctaagccgctgcctccgacagtctcgtgagtncttgactcttgagaatcgagggaacgcatttacggacgcaagactggatctgaagaggcgctgacga

SEQ ID NO: 5403 - DNA, 277 bp, Zea mays
  misc_feature: Incyte ID No: 700350084H1
  unsure 79, 130: a, t, c, g, or other
gggagcggtccaagcgccctgcgaagaaactacgccgatggcttcggcggcggcgtgggagggtccgacggccgcggantgaagacagcgggggcggaggtgattcccggtggcgtgcgagtgaaggggngggtcatccagtcccacaaaggccctatcctcaacgccgcctctctgcaacgctttgaagatgaacttcaaacaacacatttacctgagatggtttttggagagagtttcttgttcattcaacatacacaaactggcatcaaatttc

SEQ ID NO: 5404 - DNA, 277 bp, Zea mays
  misc_feature: Incyte ID No: 700350085H1
  unsure 18, 35, 50, 65, 68-69, 110, 127-128, 152, 183, 187, 190, 192, 224, 229,: a, t, c, g, or other
tcaagtccaaccaccccnccatccgatgcgtcgtnctcgacatgggcgcngtcgcggctatcganacnntcggtctagacgcgctgtccgagctcaagaaagtcctggancaaaagaaacatcgagnnggtgcttgaccaacccggtggggncggtggcggagaggatgttcaactcggcggngggngananttcgggtcgggccgctcttcttcagcgtaggnagagnccgtcncggcgggggcntgcaaagnggcgcagcctgacgacgacgaca

SEQ ID NO: 5405 - DNA, 275 bp, Zea mays
  misc_feature: Incyte ID No: 700350087H1
  unsure 2: a, t, c, g, or other
gngctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcagcttggtgatgctcagcagttgaggaggcagagaga

SEQ ID NO: 5406 - DNA, 158 bp, Zea mays
  misc_feature: Incyte ID No: 700350088H1
  unsure 2, 9, 15, 29, 43, 50, 53, 101, 103: a, t, c, g, or other
gngagagcnacgganaattctctaatcanacaatggctactangtttgangtncaaacagcaccactgagtgacggagttctccctgggattatgcgtcananagtgatcgaggtgtgcctgatattggatatcccagtacgagaggtctctccatcg

SEQ ID NO: 5407 - DNA, 253 bp, Zea mays
  misc_feature: Incyte ID No: 700350090H1
  unsure 45, 77-98: a, t, c, g, or other
ctcgtccggcaggcgacgactcgattccttcctcccttcctcctncctcgtctctttcatcggcgactccgatcttnnnnnnnnnnnnnnnnnnnnnnaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttccag

SEQ ID NO: 5408 - DNA, 275 bp, Zea mays
  misc_feature: Incyte ID No: 700350092H1
  unsure 55, 122: a, t, c, g, or other
gtcacaccccgtgtcgaaaccccagggcgccaagcttcccgcgggccaccgccgntgccgatgccggtgccgaagccgatggagaggaagcaagccgcctacagcaacctcgatgagaggtncgcgatccagggggagaagtaccaggggcagcagtacagccatatctacttcacgcgcctccaccacatgcggaatctcctccacgccctcgtcccctcctggaagccgcaacttcctgttcactacagtgttaggattgaagaggaaaggga

SEQ ID NO: 5409 - DNA, 271 bp, Zea mays
  misc_feature: Incyte ID No: 700350093H1
  unsure 185, 253: a, t, c, g, or other
gaatatatggtaaattcatggttcatcgaccattcatcaggaaagcaattaacaacatattctacaggtttatattcgaaacagagaaacataatggtgttgcagagttgttggagatcctgggcagtattatcaatgggtttgccctccgcttaaggaagagcacaaattattcctgttcgtgncattgatccctcttcacaagccaaaatgtgtatctatgtaccatcagcaggctatcatattggcatcnacagtttgttgagaagga

SEQ ID NO: 5410 - DNA, 274 bp, Zea mays
  misc_feature: Incyte ID No: 700350094H1
  unsure 30, 114, 142, 249: a, t, c, g, or other
gggctgcttgcctagggtttcgcctgctcncggccccgactccagccgtcgcttgagatctcgccgctgccgccactcgatcctaccttcgttgttcctcactgatcctgctgngctcggattttcgcccttcctccccgcnggaacagcgtccggacgcgcgggcgcagatctgggttttggtggcccgcttgttgtatgagaaggcctctaaagcttgggagcaatggaggtggagccagcgagganggacgcggcagcctgggacctggag

SEQ ID NO: 5411 - DNA, 174 bp, Zea mays
  misc_feature: Incyte ID No: 700350101H1
tccgctcctttccagctcgctctctacctgcaccagcctcgcccgcccttcgctcgccgccgccatggggaggggaaagttcaagggaaagcccaccggccgccgcaacttctccacaccggaggagatcgctgctggtacttcaggtcgccctcgcacctttaagaagaagga

SEQ ID NO: 5412 - DNA, 189 bp, Zea mays
  misc_feature: Incyte ID No: 700350102H1
  unsure 10, 17, 29: a, t, c, g, or other
agtacctggnatctaantggacttggttntcttgcaacaacacaacgagagtatgttgctttacacgctttccgccgtcttagtgtgcagatgcaaaatgcaatacttcaaccaagtccagagcatttcccgaagtatcaagagcaaccaccagtgctgccagactgcttcaccccaaatttcgctgac

SEQ ID NO: 5413 - DNA, 300 bp, Zea mays
  misc_feature: Incyte ID No: 700350103H1
  unsure 216: a, t, c, g, or other
aacaagcattacaagcgcgacgacacccggcatagggcttgcgtttgaccgtaatgggtcgtgtgccatacggaacatcgtttctggataaacaggccgaagaaaggtcctgggacatcaacctaggatggttcttagagccagtggttcgtggtgactacccctctccatgagatcattggctagggaacgactaccctcttcaaggacgagcanaaggagaagctcgccggttcctataacagttggggttaactatacacctcaggttctccaaaaacatcgatatctcaccaacta

SEQ ID NO: 5414 - DNA, 302 bp, Zea mays
  misc_feature: Incyte ID No: 700350104H1
aatgcttgcagggcctcctatttattctgtgtgctttatgcccaccggatgtatcaaaggttcgtgtgggacagttgactccatatggtatagagacacttcgaaacatcagagattttcttgacgtcaagttcatcatcaagcctgatcccaattcaaacaccgttactttaaaatgtgttggcgcgggagtgaagaatcttgctcggaagatttcataagcaacatgaccataatctgatgaaggatccagccacatcaagagactactatgagacctatttgtaatgcaaacaacagtg

SEQ ID NO: 5415 - DNA, 300 bp, Zea mays
  misc_feature: Incyte ID No: 700350106H1
  unsure 35-36, 52, 101, 184, 240, 250, 286: a, t, c, g, or other
caccaactctccccaatccagcagccctcgagtcnnttcccccacccctcantgcgacgaaggtaagatgttcctgcggaggatcctgaccggcgggggcngcctggcggccctgagggcggcgcgcgccgtgaaggagacgacggggatcgtgggccttgaggtggtgcctaacgcgcgagangttctggtagggctctacgagcgcacgctcaaagagatccaaggccttccccgaanacgagggttnaccgcaaggccgttgaatcttcacggttcaccgccntccagatctgccag

SEQ ID NO: 5416 - DNA, 306 bp, Zea mays
  misc_feature: Incyte ID No: 700350109H1
gaatttgtccgcagttcctgagtctgacttgaagaggtgggctgaactgacaggcagggaacataatttttcagtaccatctgaagccagtgactttgagtcatggaggaatcttcccagcactgattttgaacttgacaggccacatccaccggccgcaaagagtgccacttcatggccagaagaagggattgaatggttcaggtctcaacctttcaactcccaccatcatcagacgatgggatggactttcaccgaaatgtgccaaacgccgcaggatttctttggccaggcgtagaggaggac

SEQ ID NO: 5417 - DNA, 99 bp, Zea mays
  misc_feature: Incyte ID No: 700350113H1
  unsure 42, 47, 80, 95, 97-98: a, t, c, g, or other
tgttttgaattttatgacaattccagtccatcattgcatgtncattncagagtatccttatacttgaattgccgattttnctgtttccaattccncnna

SEQ ID NO: 5418 - DNA, 196 bp, Zea mays
  misc_feature: Incyte ID No: 700350114H1
gtgcctaaaacaaaggactcgggtgcttcatcagggtttactggactgacagacaacaaaaagctcagcaatgaccagcagcaagcagcaaaggctactgttcaagtatcaaagaggcctatcgcttttggagctctgtttggaaagccagctgctggaagaaggccagatcttttcctaggattttcaaatgttc

SEQ ID NO: 5419 - DNA, 301 bp, Zea mays
  misc_feature: Incyte ID No: 700350116H1
  unsure 221, 278, 288, 300: a, t, c, g, or other
ccgagggcagggaatgtgaggatgcggaagcccaaggccagggagcctaacaagagggagatgagcctggaggagaagaacatgctcagggtggagctggagagtttgcccgaagagaagatgcataatgtgctacagattgtgcgcaagaggaacaacaatccggagatgctgggggatgagatcgagcttgatattgatgagatggatgttgagacacntgggagctgatctttctagctaacttcaacaaaacgctccaggaaatctcacgtgcngtggtgatgnatggtggccccnc

SEQ ID NO: 5420 - DNA, 300 bp, Zea mays
  misc_feature: Incyte ID No: 700350119H1
  unsure 95, 131, 192: a, t, c, g, or other
cacgccaccgacatcgcctcgtgacccgacgcactgcgccaggggacccagccagctagctacatccactgatccacgcgcattccccgtaccancgccaccgcgccgcgtcacggaaggaggaggatgtngtcgtctccctcgccggcggccacccgcctggatctggatggcaaccccatcgctcccctnaccatctgcatgatcggcgccggcggcttcatcggctcccacctctgcgagaagctatggccgagacgcaccacaccgtcctcgtgttgacgtctactgcgacagatc

SEQ ID NO: 5421 - DNA, 289 bp, Zea mays
  misc_feature: Incyte ID No: 700350120H1
  unsure 225: a, t, c, g, or other
agatgatagcagcctagccattacagacatatgtccgagtaatgatggctcattggttgctgtagctattcaaagtttcagtggcataatgcttttagcatgtgatttggtaggaaagaagctatcttcctaaaggtgattacaatggaaaagagttatattcctactagcctagcatccagctcggcctcggaacttccgtggactgtcagggcgcatcaaacngcccagccaggctctcccatctttgacccgttaaggatcatcagtgtttccaaaggacagatat

SEQ ID NO: 5422 - DNA, 292 bp, Zea mays
  misc_feature: Incyte ID No: 700350122H1
  unsure 279: a, t, c, g, or other
cacatagcacattattgtctggttacttcagtaaggtggtaatatgtttgatgctgaggaagactgctccacttatgagttatgttcaggggcatccaaagatagttgtccagcttgttgacctgattggcatcacatcgataatggaggtgctgatacgactgattggtgctgatgagaccatatattcaaactatggtgatacttgcagtggttagaaaatacagatgtcctgaaatgattgcagacagtttggctcatcggattctccgaagtgcngccatgctgcgga

SEQ ID NO: 5423 - DNA, 293 bp, Zea mays
  misc_feature: Incyte ID No: 700350123H1
  unsure 45, 265: a, t, c, g, or other
cgccgcgggttgcccacaatcaacactgcggcgatcacagctttngtcgacaggtggcggccggagactacacactttccatcttccttgcggcgagatgaccgtgacactgcgagacagccagaagcagcttggtctcagtattcgtgggcgtccagtgaccggtcaggcagcacccggtggctggagacagagagtcgaggctttcttggaagggaggttcccacagacacaccagtagccacacatctggggtttctctcgnctggcttaggcaatcttcgggatgtcca

SEQ ID NO: 5424 - DNA, 307 bp, Zea mays
  misc_feature: Incyte ID No: 700350124H1
  unsure 2, 60, 241, 246: a, t, c, g, or other
gnggtcgtccctcagccgcgtcgcaccgcatcgcattctacgattcgaagctctctgctncgcaggggaccatggcgaagaactacccaaccgtgagcgccgagtacagcgaggccgtcgagaaggccaggcgcaagtccgcgcccttcatcgccgagaagagctgcgcaccccttcatgctccgcctacgcgtgggcactccgcggggacgttcgacgtgtctccgagggaccggcggtnccttncggtaaccatgaagtgccggcggaatggctcaggcgccaacgcggggctggacatcgcggt

SEQ ID NO: 5425 - DNA, 293 bp, Zea mays
  misc_feature: Incyte ID No: 700350126H1
  unsure 127: a, t, c, g, or other
cacagggcaaagcttgatgacaatgctagactactcgacttcacccagaagcttgaggctgcctgcgttggagccgtcgagtctgggaagatgaccaaggaccttgcccttctcgttcacggatctncaaatatcacgaggagccatacctgaacacggaggagttcattgacgctgttgctgacgagctcagatcgagggctggcagccaacttcgaactttgaaatcctgccgaagttgtggtgctttcctgcgcgacgtttcgaacgttttaattagtcgccatttcttc

SEQ ID NO: 5426 - DNA, 289 bp, Zea mays
  misc_feature: Incyte ID No: 700350127H1
  unsure 2, 72, 283: a, t, c, g, or other
gngatgatagcagcctagccattacagacatatgtccgagtaatgatggctcattggttgctgtagctattncaaagtttcagtggcataatgcttttagcatgtgatttggtaggaaagaagctatctttcctaaaggtgattacaatggaaaagagttatattcctactagcctagcatccagctcggcctcggaatccgtggatgtcagggcgcatcaaacagcccagccaggctctcccatctattgaccgtttaggatcatccgtgtttccaaagganggatta

SEQ ID NO: 5427 - DNA, 293 bp, Zea mays
  misc_feature: Incyte ID No: 700350129H1
  unsure 99, 115, 238, 287: a, t, c, g, or other
gagacttggacataatgaaactataaatgaaggagttcggcgtttccacatcttctttgaagacggcaaaacttcccttcttccaccagatactagaanggctgcatatcttgcnctgatgcgaactgttagcacctcaagcagatccggttttgatgctctcctaaaatctacagagaagcatctgaaccacaggagaaatcacgtgtcttaggctccccgtctcatcacggatccngatattgttttggaggcattgaactttagtttactgatgaggtgcgganccagaa

SEQ ID NO: 5428 - DNA, 293 bp, Zea mays
  misc_feature: Incyte ID No: 700350130H1
  unsure 161, 198, 288: a, t, c, g, or other
cgaggccgggggaagttcctgcggagtgctcaagggcagaagaggtgccgcgtcccgaagaggggaagcggagaagtttgctgctgcccgggtcgcctcgcgacgctgagagaatcgcccagccctccgcagccgcccagcgagaaccggagctgcggccncgcaccggcgtgagtccagctgagctgacacgccganccggttgtgcctttccgagggaggaatgtgcctggaatccaactttggaaacgtcccacccgattcccagcgagcagcaaggagacaaancgtca

SEQ ID NO: 5429 - DNA, 127 bp, Zea mays
  misc_feature: Incyte ID No: 700350131H1
gcctcgtagataaaccagcactactcatccgtcgccccacgcccccacggaagtttcggcggcgccggcgtgctcgtgatctcaaccataggcgtgcctccgctccggttcacccgtctccacgcaa

SEQ ID NO: 5430 - DNA, 188 bp, Zea mays
  misc_feature: Incyte ID No: 700350133H1
  unsure 36, 38, 48: a, t, c, g, or other
agctgatcccatactgctttgctagatgcctaacancnggtgtaaatntctctacaccagctgatcccatactgctttgctagatgcctaacagctggtgtagagagatttccaccaggaacattgccttcacttgagaaaactgcagactctagtccaagggacttaccagcggatggaactatatt

SEQ ID NO: 5431 - DNA, 294 bp, Zea mays
  misc_feature: Incyte ID No: 700350134H1
  unsure 226, 231: a, t, c, g, or other
tccctcttctctcctccccttgctcttctctggccgccgccacttgccaggacttcctgcagcagagcgcccctgcagctccttgcacctgcatcctacgcgcgctccagccgaccacgcccaggaaccagtgcagcgctccatcatcagtaggtgactgacggcacatgcgccaccatgccaatcatccatatgatccgtctcccacatgcctgcccgccgtagntggcnaaacgggcaagggtcgttgtgtctacgctgcggctgcggtaaccgacggcgtctgattggata

SEQ ID NO: 5432 - DNA, 292 bp, Zea mays
  misc_feature: Incyte ID No: 700350135H1
  unsure 20, 59, 61, 64-65, 72, 106, 158, 181, 190, 240, 254-255, 261, 278, 287-288,: a, t, c, g, or other
gggctattagagggaactgnccattttaaagaattgcatgagattattgaagatgcaanancannattgganagtgaggttgggccacttgatggaatgtcggcanagaatgcacatggtatcgtaagcaggttctcagctggtatcgctgtgcaganactatgctctacagcaattcaangagctgacnagtggttgagctctcctgaccgtcatcttcgagattcattacctgttgcntgtagatttaaatnngtaganataacatcttcttcccncatgtcaanngana

SEQ ID NO: 5433 - DNA, 290 bp, Zea mays
  misc_feature: Incyte ID No: 700350136H1
  unsure 59, 76, 141, 156, 217, 242, 272, 275-276, 280: a, t, c, g, or other
cgagctagcaggctagcagcaccaggaccaggagcctcttcccacacttccgctctccntctctctctttcctctncgagaatggttgtgtaggcgggcgcaggagggaggagagagaggggagctagctagggttttgcntcgccgccttctgtnacccttaggctctgaacccctccggtccagtgcggcggcggattaggctccgatggggaantctccggcgaatggatcaagtccgngctcttcggtaaaaatcgtcgtcgaggttnggnnccancaaggccaag

SEQ ID NO: 5434 - DNA, 290 bp, Zea mays
  misc_feature: Incyte ID No: 700350137H1
  unsure 3: a, t, c, g, or other
ggncaaatgaaagcctctatgagcagaagcccgaggaaccagctcccgtcctgccatcatcggtgattgagagtactacaactaggagcaaatcacatacttcccgatttgattacgttgaaaatgcacctgctcttaagaatgggaatagctcagaaggcaaccacatgagtggacatgttgcacccccaatgtcgtcaaacttctttgctgaatttgggatggacagtggatatcagaaaaaatctacgtccgttcatccaagtgcagatcgaggaagcagggagcag

SEQ ID NO: 5435 - DNA, 93 bp, Zea mays
  misc_feature: Incyte ID No: 700350138H1
  unsure 54-55: a, t, c, g, or other
gtgcccgcaggccgcagggctgtcctcctgtgatgccatggtgatttggagttnntcttcttgtctccatggattcattcccagagcggcatg

SEQ ID NO: 5436 - DNA, 283 bp, Zea mays
  misc_feature: Incyte ID No: 700350139H1
  unsure 2, 231, 240, 255, 267, 270, 279: a, t, c, g, or other
gngcgccctcccagttcgtctattaaaggggaaccagtgaaccacccgatgcaacttgcgtagagagttgggcgcagagaatccccaagcaaacaaacagggtagaggtagagggagaggagaggagaggagaggagaggagaggttgggtctgggacaccatggctccgatgaagctgtacgggcgtgatgtcgtggaactgacgaggtgcgcaacgcgctggaggaggnggctccgantacgagatctgcccnccattcgccacngcngagcacaangccc

SEQ ID NO: 5437 - DNA, 289 bp, Zea mays
  misc_feature: Incyte ID No: 700350140H1
  unsure 12, 192, 202: a, t, c, g, or other
ggatttgtctcncctccactgcgcctctccgtttccgccatggctccggccgccgccttcctgtccggcgtgcgccgctggttccattccccgtgcgcccttcctgatcccgaggcctcttcttctcccaattccgctctcccctgcgcgctgggaccgctcccgcagctgcagcctctttggcgtaggcgncaacactcgncgcgcgccaacccttcgacggaacgcctccacggagaggtggttcctacgtgcgggctctggcaatacatagcgcggactactcgtg

SEQ ID NO: 5438 - DNA, 291 bp, Zea mays
  misc_feature: Incyte ID No: 700350141H1
  unsure 66-67, 135, 218: a, t, c, g, or other
gcattctcgccggtgctgctgcaattaacgccgcctccggccaaccacccgaaacctacctccgcnnccgtcgtcgccaccgtcaacatggcgagccaaggggagccctcggcctctgcttccgatccgaagganaagaaggacttctcgacggcgatcctggagaggaaaaagtcaccgaaccgccttgtcgtcgacgagggccaccaacgacggtnaatccgtcgtcgctctgcaccctgacaccatggagaggctgcagtcttccgcggcgacacgtgctcctcaagg

SEQ ID NO: 5439 - DNA, 292 bp, Zea mays
  misc_feature: Incyte ID No: 700350143H1
  unsure 52, 202-228, 280: a, t, c, g, or other
ggtctggagtctttgaatccaaaagagctccaacaactagagcagcagctgncgagctcactgaagcacatacagattcaagaaagagccaccttatggccgagtcaatttctgagcttcagaagaaggagaggtcactgcaggaggagaacaaggctctacagaaggaactttcagagaggcagaaggcggttcgctagcnnnnnnnnnnnnnnnnnnnnnnnnnnntgggaccagcagacacagttccagtccagacagctcatcgtcttcttcttcngatgaggcagga

SEQ ID NO: 5440 - DNA, 199 bp, Zea mays
  misc_feature: Incyte ID No: 700350144H1
  unsure 130-131: a, t, c, g, or other
gcctcttgcccgttgcccctcggtttcgtcgccgctacccggcgatctccgcgacaggacccggtgccgccgccgcagatctcgccgagaagacaggtatcggtgccgccgccagatcaactggacctgnnaaacgagggcctgcgctacctgtggagttcccgaggcgctgttctgccaggattcggcatctttggtt

SEQ ID NO: 5441 - DNA, 106 bp, Zea mays
  misc_feature: Incyte ID No: 700350145H1
  unsure 74: a, t, c, g, or other
aattgcggtggccaccacttccaatccactccccgcgttcgcctgcgccgagctgttcttgctctgtacctctncttccaactaccacgatttgttccacacaaca

SEQ ID NO: 5442 - DNA, 224 bp, Zea mays
  misc_feature: Incyte ID No: 700350149H1
gatcggacaaggcgccggagcctcagcaatccctgagcagactagaggagtagctaaggcaaagggaggtggcaaagatgctgccgacgaccgcgtccaaggggcgcgggcctcccgctccgccccgccgctcttcggtccctacctccgccgcatcgtcaagtggcaacaaatggatattgaatacacattttggcaatggttcatctctgtacttcacaaaa

SEQ ID NO: 5443 - DNA, 184 bp, Zea mays
  misc_feature: Incyte ID No: 700350150H1
  unsure 100: a, t, c, g, or other
ctgaaagatccaagaatcctactattggatgaagctacagagtgctctggatgccgagttctgaaaggattgtgcaggaagctcttcgacagggtcatgnacaaacaggacgacagtcatagttcggcacaccgtctgagacactgttcgaaatggctgataccattggtgttattcatcaggg

SEQ ID NO: 5444 - DNA, 284 bp, Zea mays
  misc_feature: Incyte ID No: 700350152H1
  unsure 141: a, t, c, g, or other
attctccgctctccatttattcctttccagttccgccgctccattcccagctcccaccaccaagggcaatccctctcccgacatccaatccaatacaatcacgcctgcgcacacgcaaccccagctcaagccccaagtccnaaccctaacccggcggcggaagatatggccgacacggggcgcgacgccttccctgacgaggcggagccgcgttcaccctcgacgagtacatggaggacatcgaggccgtggagctggaggcggatttggtgctgggcggggac

SEQ ID NO: 5445 - DNA, 278 bp, Zea mays
  misc_feature: Incyte ID No: 700350153H1
gtaaagggctaagattgcagttattagtttataatgtattgaaccttcaactttccaggaacaaaggttggatactttaagacacagattgcaaatctcttttgatggctcccgtattgaacatcaagtgtgtattactgatgtagattggttttctaggttgacatcatctcatgaagtaaattaattaataatttatgggctttatcattattagggtgcctgaggcaactccggcgtttagcttatcccgctcgtgagattccaccatcaatctg

SEQ ID NO: 5446 - DNA, 283 bp, Zea mays
  misc_feature: Incyte ID No: 700350157H1
  unsure 45, 170: a, t, c, g, or other
gtcggctgcttctccaagccggaggaagcgtcatggacagttganggatcagtcagatggaggaacatatttggttatggtgacatctgggatgcttcgggagcatatgggtgggaccagtcatcagagataagcattggagtatccttaccaagattgagatcgatacnaaccccctcgactgctcgggcatcactcttgtctcatgactggctgaaattttcatcatacaaggaacgtctgcttggctatcctttggtttgctttcggacatgcaccatga

SEQ ID NO: 5447 - DNA, 282 bp, Zea mays
  misc_feature: Incyte ID No: 700350158H1
  unsure 19, 41, 55, 116, 118, 132, 134, 138, 141, 159, 191, 195, 207, 216, 229,: a, t, c, g, or other
cgctccctacacacccgcnctccggtgtgaacctccatgangtctgcaaccactntccgatctgctgtcgtgacctccatccagccgtgctgtggcagtggatcggagttcgctcnanctctgattatcccnangtcnagngttacaagaagatccaancttggttgtggctgctgctgtgttgcctcctnttgntggaccgaaganagggagganagaagcagctggngtgnagattctactcaggtggtcttnatntnaatggggcttctaggatcnanc

SEQ ID NO: 5448 - DNA, 196 bp, Zea mays
  misc_feature: Incyte ID No: 700350159H1
  unsure 23, 66, 78: a, t, c, g, or other
acgagattgttgaattcatctcngccctagcaccagccatggcgaacgccaggcttcttctctgtntccctactcgcngcctccgcgccgctaatcgtcgccacggccaagaaatccggggacgtgtcggagctccagatcggcgtcaagtacaagccggaatcatgcagcattcaagctccacaaaggtgacaag

SEQ ID NO: 5449 - DNA, 280 bp, Zea mays
  misc_feature: Incyte ID No: 700350168H1
  unsure 3, 241, 248, 269: a, t, c, g, or other
ggnccgccgctcgctcgctcgctgcagctacgcacgcacgcgcctgctcctccccttagcttccacaaggctcgactcggccggcggcgatggcgcggaagaagatccgggagtacgactccaagcgcctcctccgggagcacctcaagcgcctcgccggcatcgacctccagatcctctccgcgcaggtacacacagttcaacggatttcatgagcttgcaaaccaggagccgtggtctnatctatnaagttggttgtgaaacctganatgctctttgg

SEQ ID NO: 5450 - DNA, 276 bp, Zea mays
  misc_feature: Incyte ID No: 700350169H1
  unsure 199, 245, 259: a, t, c, g, or other
gggggctcatgatgccagtgtctgtgagctcaatggcagcagatgtgatccgtgggtactgggcgcaacggatcttgtgggagattggtggatatgtggctttctatccacctactatttacaggaaggactatattcaggcatacccatttgcagaagagaaggatcttcatgtgaatgttggtcggttgatcaagtnctgaatgagtggaggtccaaacaagaggacactctttgagaagatnctgatttgagttangcccaggctgaggaggg

SEQ ID NO: 5451 - DNA, 282 bp, Zea mays
  misc_feature: Incyte ID No: 700350170H1
  unsure 23, 256, 273: a, t, c, g, or other
gggagacgaaatgaatatgagangcacaagctcttggccttaaatcagaggcagaagatggtcttacagaggaaaactgaggaagcagctgctgctacaaaaagattgaaggagttgctggaagcaaagaagtcatcacgggaaacatatggcagtggcaaatggttccggggatgcaggcctaatacgagctattgaggatgaactagaagtccactgtaagagccacacgaattggcgctcatattacgagcgnacaatgcagagcgagcngcatatcca

SEQ ID NO: 5452 - DNA, 280 bp, Zea mays
  misc_feature: Incyte ID No: 700350172H1
ggagagcagcccggaggagggggagcaagcagcagccgtcggtggaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacc

SEQ ID NO: 5453 - DNA, 276 bp, Zea mays
  misc_feature: Incyte ID No: 700350174H1
  unsure 13, 17, 32, 61, 91, 123, 125, 131, 134, 160, 177, 179, 190, 241, 250: a, t, c, g, or other
caaggtggccctnacanccaccagattgctgnacttgctgttgctctacagcaaactatgncgcctggcttcaaggcctatgcaaagcaantgaaggccaatgctgttgcaattggaaactancncatgancangggctacaagatggtgactgatgganctgagaaccaccttgtncnctgggatctcngcccccttggcttgactggaaacaaggtcgaaaagctatgtgatctttgcnaatcacttngacaaaaatgtgtcttcggtgaaaca

SEQ ID NO: 5454 - DNA, 179 bp, Zea mays
  misc_feature: Incyte ID No: 700350175H1
  unsure 177: a, t, c, g, or other
gaccaagttctacaccgaccaggaagcccgagatccactgctccccgacaccgcaccgctacttcaatactacgccggcgaagaaacagcaacagcaacagcaacgacggctccactggcaacaagagcgtcttctggatcgtctgcgcgtgatagagttccctgagtctccggggnga

SEQ ID NO: 5455 - DNA, 283 bp, Zea mays
  misc_feature: Incyte ID No: 700350176H1
  unsure 163, 218, 245, 260, 276: a, t, c, g, or other
gtcttgccggcgatgagaacccgtcagttccaaagatggctcgtcgtggattgatggaacaggacttaagcaaactggatgtgacgaagcttcaccccctgtgcacctgaagttatctcacgccaagcaacaatcaatatgggtaccattggccatgtggctncatggaaagtcccactgttgttaaagctatatctggtgttcagactgttcggttnaagaatgagtggaacgtaccattactntaaagctgggtaacnctaatgcaaaaaccanaattggg

SEQ ID NO: 5456 - DNA, 280 bp, Zea mays
  misc_feature: Incyte ID No: 700350178H1
  unsure 101, 242, 268, 270, 276: a, t, c, g, or other
gtgggagtgaatgtggatgatcagttgcctgatgccaatgctattgaggaaaatacagttactgttacagaagttcatcaggaaactgtggttgatgtcanttcatcaagttgaagttcctacaaccgaagttggtcaagaatccataatttctcccactagaggcccccccagtgttgatgttgaagaggcctcaacaaccaaaggaaaagtactgaatcagttgctcgaggaatttgacnttgaagaagtgcagtgcatactaaantnctatgngccc

SEQ ID NO: 5457 - DNA, 227 bp, Zea mays
  misc_feature: Incyte ID No: 700350179H1
  unsure 65-66, 89: a, t, c, g, or other
caattcctctacggcccaccttcttcctacctgccattctcccatccagcacagcagggcgtctnntcctcctccctcccgcttttatngccgcctccatttccaggacgcgtcgaattcctccatctaccgcgccggccgccgaggcccgagggggaggaggatgctgggcgccgcgaggaggcagcttggatccggtcccatgctgggacaggttttgcgaagtc

SEQ ID NO: 5458 - DNA, 293 bp, Zea mays
  misc_feature: Incyte ID No: 700350180H1
gtgacagagaagattcagtcacattattccaggattctgaatttgatgcttcagagttcacttccatccatactgaaagtttatgaaaatgcagaattcatgtggatgtcttactgaggatcttgcttgccaatacatatcactttacttgaaactagaaagactggaggaagctaagactctcggcagaaaagctttgtgatggtcctcttcaaatgctggcaaatttgtggagcctgagattactatggagataaattccattgcaactgctccggcagttcttcctgagc

SEQ ID NO: 5459 - DNA, 273 bp, Zea mays
  misc_feature: Incyte ID No: 700350182H1
  unsure 114, 223, 238, 256, 261, 265, 267: a, t, c, g, or other
acctctcaaaccctagccgcctcctgcaagtttcagagctcaggaatctgcgccatggcgagtgagacggagaccttgcgcatttcaggctgagatcaaccagctgctctcacncatcatcaacaccttctactccaacaaggagatcttcctccgcgagcttatctccaactcttccgatgcgctggacaagatcaggttcgagagtctcatgacaagagcnaagctcgatgcgcancctgagcttttcaaccanctgtnccangncaaagc

SEQ ID NO: 5460 - DNA, 133 bp, Zea mays
  misc_feature: Incyte ID No: 700350183H1
  unsure 13, 22, 29, 34, 40, 45, 63-64, 66, 78, 84, 87, 99, 106, 123: a, t, c, g, or other
tggcttgtatccntctctcgtntctccancgacngcagcnggcgngggttacgcgaaggcgtnngnagtagtggaagnagaggnggnagcatggccgtnatggagnagctcaagatctttgtngttaaggagc

SEQ ID NO: 5461 - DNA, 274 bp, Zea mays
  misc_feature: Incyte ID No: 700350185H1
aatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgttcagcggcaaactgttacaaatctgagcatctaaaga

SEQ ID NO: 5462 - DNA, 273 bp, Zea mays
  misc_feature: Incyte ID No: 700350186H1
  unsure 147, 215, 264: a, t, c, g, or other
tgctacaccaccacacccacaccccatcccagcacacaacaagcagcctggtttacggtagctgctagcaaaacaatggagaaccctgctccgagcatcgtagtggccatcgccgcacccgtggcggcggagttcgtgaagctcacnttacgtgccctgtatatgcgccgggctggtcctggcagcagggagatgactgtgccgggaaggccatnccgaccagctgggcaggagagtagtcatgcaagcccgtgtacgaaggcngtggcgccg

SEQ ID NO: 5463 - DNA, 199 bp, Zea mays
  misc_feature: Incyte ID No: 700350189H1
  unsure 124: a, t, c, g, or other
ggcaatgaagtacaagtcggaaggtcatgacatggtcatcattgctggctccgagtacggcagtggcagctctcgtgactctgctgccaagggaccaatgctactgggtgtcaagtcggtgatncgcaaagagcttcgagcggatccaccggagcaacttggtggggatggggatcattcctctctgctttaaagcagg

SEQ ID NO: 5464 - DNA, 274 bp, Zea mays
  misc_feature: Incyte ID No: 700350192H1
  unsure 93, 126, 131, 177, 187, 197, 204, 221, 236, 241, 246, 252-253, 257, 270: a, t, c, g, or other
gtgggagtgaatgtggatgatcagttgcctgatgccaatgctattgaggaaaatacagttactgttacagaagtttcatcaggaaactgtggntgatgtcactcatcaagttgaagttcctacaancgaanttggtcaagaatcctaatttctcccactagaggcccccccagtgtngatgttgaanaggcctcaanaaccaangaaaagtaccctgaatnagttgccggggaaanttggnatttnaagaanncaanggaatcacaaaanaaaa

SEQ ID NO: 5465 - DNA, 159 bp, Zea mays
  misc_feature: Incyte ID No: 700350193H1
ggatctactgtgcaagtagtaatgaggaatggtctgtttagatgctagcaagcggtttgcggtgaacctttcttatctgtgccatttggaatattcaacgtaacctaaccctggagctgcacgtgttgacaaacttgtcaagttgcgaggtgaactgaa

SEQ ID NO: 5466 - DNA, 282 bp, Zea mays
  misc_feature: Incyte ID No: 700350196H1
  unsure 9, 46, 225, 257, 264-265: a, t, c, g, or other
tggcgaganctggaagaactccgaggcggcctcgaatgcgcctgcnatgacgggcttgctgacgccgtggttcaccacctgttcaatcggcaccacaaggatatggtagcgtattgatcagcattggcactgaagcatcacaccagaatccgaggtttgcacaacatggagtttgttgactgatcactggtgagttgccgttaaagtttccatggtaagtaagcnggtcaactttggtcaaacgttcgtgactgcantggtganngcacttgtttaaaggcc

SEQ ID NO: 5467 - DNA, 191 bp, Zea mays
  misc_feature: Incyte ID No: 700350201H1
  unsure 23, 28-29, 35, 45, 49, 58, 110, 141, 148, 172, 176: a, t, c, g, or other
acagcatatgttcgtgcattgcnaccgnnaaatanagatgaagangtanctataagcnacattgagactgcggcagtcaccaagaagagaaacaatgatctgaaacagtncttcttcacctggcacatgtccacgctgtgnaaagggntttgatgaggatgcactacttgangggntcaggtgcaagagcc

SEQ ID NO: 5468 - DNA, 240 bp, Zea mays
  misc_feature: Incyte ID No: 700350202H1
ggcgctagttaaaaatgcttgtttccaaatgatgaggaatgcactgcgccaacaacgatataagctgaagaaacaatattttgacccttttccgctacatctagtgaggaaaacatctcctatcaaatcgacaagtgatgaacaatggaatgaccttgtggaacattggaaaggtccaaaaaatatggcgacatgtgaacataacaaaggcaaccgagggcaaagttaagttccatcaaa

SEQ ID NO: 5469 - DNA, 246 bp, Zea mays
  misc_feature: Incyte ID No: 700350203H1
  unsure 93, 228: a, t, c, g, or other
ttgcgtctctcgcgcgttaccaagctctcaagttttctcgcgccgacggcaatggatgaggtcaccgaggccgtgaacaacctcaacatctcnggcgtaggggccgcgggcgttgccggggcggaagggcacaagaagaatcgcatccaggtctccaacactaagaagcccctcttcttctatgtcaacctcgccaagaggtacatgcagctgcacaacgaagtaggnctgtcggccctcggcagg

SEQ ID NO: 5470 - DNA, 311 bp, Zea mays
  misc_feature: Incyte ID No: 700350208H1
  unsure 259: a, t, c, g, or other
ctctgagagtgatagctgaacgactttctgaggaggagattgctgggttaagacaaatgttcaaggcagttgacgttcaaaatagaggcgtaattacttttggtgaacttagacaaggtttaaaaagatatggtagcgaattggagaatagagaaattagtgatataatggaagtggctgataatgacaataatgtgaccatcaattatgaagaatttatcgctgcaactgtgcctcttaacaaaatagaacgtgaggngcacctgatggcagcttttacctacttcgacaaagatggaagtggttatatc

SEQ ID NO: 5471 - DNA, 186 bp, Zea mays
  misc_feature: Incyte ID No: 700350210H1
  unsure 9, 62, 66, 74, 88, 96-97, 102-103, 106, 137-138, 144-145, 148, 157, 159,: a, t, c, g, or other
ttttttatngggaagcattgtttcagacacacgagaatctggaacacctagcaatgatgganaggntttggganctcctaccagaggngatgatanngaaannaanctcttcagctgcagaaatattttaggagagnnacacgnntanattggccgntnagtgctgttncangagaaagcatcana

SEQ ID NO: 5472 - DNA, 308 bp, Zea mays
  misc_feature: Incyte ID No: 700350212H1
  unsure 128: a, t, c, g, or other
gatgtgtggatcattggctttaaacatgtgtggagttgcctgtggtagactagatttgtgttatgagataggatttggtggtccatgggatgttgctgctggtgctgtaattcttcaggaagccgggnggccttgtttttgacccaagcggcggagagtttgatttgatgtcgcgaagaatggcaggatcaaacagctgctgaaggataagttcgtcaaggaactgggggatactaattgaaacaaatgttagtattattcgtggaacagattaagacaataaggttgccccgccgcatggtgattaa

SEQ ID NO: 5473 - DNA, 311 bp, Zea mays
  misc_feature: Incyte ID No: 700350214H1
cggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctga

SEQ ID NO: 5474 - DNA, 229 bp, Zea mays
  misc_feature: Incyte ID No: 700350217H1
tcgaaagctcgaaagatcccgcggcgcagagccacccttctctcctctccgctcccaatcttatcgtcgcctccctcgaagtcgccgctgccttcattccaccatggcgcttcacgccccggtcctcgtgatgaaggactcgctgaagcgggagtctggcgcgaagttcaccaagctaacatccaggcggccaaggctgttgctgacatcatcgcacacattgggtcca

SEQ ID NO: 5475 - DNA, 254 bp, Zea mays
  misc_feature: Incyte ID No: 700350218H1
gtccaaagtcgcgtctcccagcctccctccactgtcccacaccccaacactgttccagtccagcggctagcactagcagacagagcccctcctccccctagctcttgctcttccacaggcacagcgcaacgcttccagctagtctcgagacgaccggcagagatgatgaggcgttgcagcatcgccgcctcgccatcttctctctcctcgtgtgctcctcatcctcctccaactgcgcggcagcgctcggcttc

SEQ ID NO: 5476 - DNA, 199 bp, Zea mays
  misc_feature: Incyte ID No: 700350219H1
cccaaattgggacattgtttaatggtgggaccttgcaggaccaagggctgggttacagttgtctttggagttgattactaactgtgacagagaggatttttctcataaaaagattttgggctcagtgtctttgtaagtgcctagatatgtaagctggctgtgcacagaaagtctttgagaacggtgacattaaacctca

SEQ ID NO: 5477 - DNA, 306 bp, Zea mays
  misc_feature: Incyte ID No: 700350220H1
  unsure 296: a, t, c, g, or other
gcaagacggggaaaagtgagcacattcttgcacgaagcttgccgccgccgagctggggaggagatcttgcctaggtctagcgaggaggaggtcgatcgatcgattggctaggactctaggaggaggagctggttcataagcagacctaccgacccacccatcgactgtacttgttcgaggaagggatggccgatctgctgagcttcctgaagacgatcttggaggccgggttcagtataatgagcgcgctggagaaggctggccacaacgcggacgactgccgcaagatcggtcantctgcaaaca

SEQ ID NO: 5478 - DNA, 232 bp, Zea mays
  misc_feature: Incyte ID No: 700350221H1
  unsure 4, 46, 103, 113-114, 118, 126, 206: a, t, c, g, or other
acanagtcaaggtttcaatctatgctgtccacaaaataagataaanttagatatataattggtcatagttccctcacgaccaactgaagtgccttatctatanccctatatanntcancacttcanaaattgcaaaagccaaccaatcaaatgtccaccatagtctacacctcttctaaatgcacccagatcaatcccaccgttanaaccaatgaacaagatcaactcaaac

SEQ ID NO: 5479 - DNA, 302 bp, Zea mays
  misc_feature: Incyte ID No: 700350224H1
  unsure 64, 165-187, 220, 290: a, t, c, g, or other
tctctccccacctcccctgagcttctcccgacctttggtcaggcaaaggaggcggccaacaagnacgagcgatggtgaccaaggtcatctgcttcctggtgctcgcatccgtgctcctcgccgtcgcttttcccgtgtctgctctgcggcagcaggtgaagaagnnnnnnnnnnnnnnnnnnnnnnncggaggcagtgttagcggaacggaggcggcaanctgaatcctgggagtgctcgcccaagtgcgggtcgcggtgctccaagacgcatacaggaaggctgctcanttatgcaacaag

SEQ ID NO: 5480 - DNA, 306 bp, Zea mays
  misc_feature: Incyte ID No: 700350229H1
  unsure 111: a, t, c, g, or other
gcgaacagctggaggaagaagaggctctggttgcacctgactatggcgcggttgcagaatacactgcaccaggcgctgacaactggggcggtgaatggggtgctggcgaantggcagctccagctgctagcattccagctgctggcgcagactgggctgctgctccagctcctcctgctgacggtgtctgggacgcagctgtggctccacctccagcagcagccccctcatgggaacaaggcgcggcccccgttgcggcgtcgacccctacctgggagtattaataaagagtaaatgagcatggtg

SEQ ID NO: 5481 - DNA, 301 bp, Zea mays
  misc_feature: Incyte ID No: 700350230H1
  unsure 161, 273: a, t, c, g, or other
tgcaatttcagtttgctggggcagcacaatcacttggagctggtgccattctagtaaacccttggaatattacagaagttgcagactcaatacggcatgctttaacgatgccatccgatgagagagagaaacgacacagacacaactacgcacatgtcacnactcacacggctcaagattgggctgaaacttttgtattgtgagtttctcatttccatggcccaatatcattcggtggaccaagcccctcacttataattttgtttgcaactncaagttttcggtgatatcctttcttttc

SEQ ID NO: 5482 - DNA, 303 bp, Zea mays
  misc_feature: Incyte ID No: 700350231H1
  unsure 46: a, t, c, g, or other
gttggacgcgttcccctcctgcacgcaacctcatctcgtcctccanatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaagttcttgttgttttgttttggtggtcgagcatcgcatgttctgcttctggatccagatctggagaaatcgcgaatcgtcgtcgttc

SEQ ID NO: 5483 - DNA, 300 bp, Zea mays
  misc_feature: Incyte ID No: 700350234H1
  unsure 41: a, t, c, g, or other
atcgtggactccaacttccggttcgacacccaggcatacgngcgcaacggcccgctctacctcagcaccttcttcgccgtcacctacggggtcggcttcgcgtccctcaccgccacggttgtgcacgtcttcctcttccacgggagcgagatctggcagctgagcaggtcagcgttccaagagaagaaggtggacgtgcacacgagggctgatgaggaggtacaggcaggtcccccgagtggtggttcatctgcatcctcgtcgccaagtcgcgtcacatattcgctgcggagtactaat

SEQ ID NO: 5484 - DNA, 290 bp, Zea mays
  misc_feature: Incyte ID No: 700350236H1
  unsure 181: a, t, c, g, or other
tttgaaggtacaaacatacggtatagtatgcattgtttaatagtttaatacagaaataaaagaatactgagaagagtacatcatttgatcaatccttatgaactttcagttatatgttttagtagtcacccatttaaaagaacctaaacgcctatggctgagttgattctatagctttgtnttttttctaggattagctgcgacgaggctgttttttcttggaacagttacatatctttggtgtggtactgctgattaattgtgtttaacacttcaataggaggtgatcg

SEQ ID NO: 5485 - DNA, 280 bp, Zea mays
  misc_feature: Incyte ID No: 700350238H1
  unsure 26-27, 42-43, 47, 64, 201, 237-238: a, t, c, g, or other
gtcaaaggccataggattgttttctnnctccagccctgcacnntgangctgcgatggcagctgntgtcaaggtggctgacgcggaggcaaaagcacatgatgcacatgatcagacgatggaggcagaaaggatcctcaagatggccgaggataccgagtctctcctcataattgcagcagagatctatgatcgatgttcanggggagagataaccacgttagtttccagtggcacanngggggatttgagatctattggagtctctcttgtgttgttgta

SEQ ID NO: 5486 - DNA, 300 bp, Zea mays
  misc_feature: Incyte ID No: 700350239H1
  unsure 147, 178, 180: a, t, c, g, or other
ggagagtcgtcactgacagccccgtgtacgacggccgtggcgccgacgcccgcctcgtggctcgcatacagggagtcacggtcctggtcggtaacgcagacgccttgttcaccatggtgttcgaaaccgacaggctaaagggctccncgctcgtcatcaacggaatggtcacggatgncntcagacgaatgggcgatctacggcggaaccggggtgttcgccatggccaccggtgtcatgaagagaagaaaccttgccggcggtagcaacgacgggaactctgacgagttgccctggaag

SEQ ID NO: 5487 - DNA, 300 bp, Zea mays
  misc_feature: Incyte ID No: 700350241H1
gtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacg

SEQ ID NO: 5488 - DNA, 290 bp, Zea mays
  misc_feature: Incyte ID No: 700350242H1
ttatggtaccggtggactcggaaatagcatgtactcgagttacgaaggaggttatggtggtggcatgtacggtggtggcatgtatggaggcggcatgtatggtgggatgggaggttatggtggttatggcatgggcggaatgggtggtatgggcatgggtccatacggtaatcaggatccaaattcgatgggccctcctgcatccccgccaggcttctgggtgtcttcctccgagtgatgcaggtgttgtcaatttctcggacgaatctcatcctgttgaacagaatact

SEQ ID NO: 5489 - DNA, 299 bp, Zea mays
  misc_feature: Incyte ID No: 700350243H1
  unsure 288: a, t, c, g, or other
gaaaaccctgcccggaccttcgttgcagcgctacgagcttcgacgggccgctcgatctccacctctgaagtggctgcttgtgatctagatctgaaagctgcagtggttgacagctgagtgtgaaactgtgaatcgaagatgagcgtggtgggcttcgacctcggcaatgagagctgcatcgtggcggtcgcgcggcagcgggccattcgacgtggtcctcaacgaggagtccaagcgcgagacacccgccatcgtctgcttcggggacaagcagcggttcatcggcancgccggcgccg

SEQ ID NO: 5490 - DNA, 297 bp, Zea mays
  misc_feature: Incyte ID No: 700350244H1
  unsure 48, 50, 239: a, t, c, g, or other
cattgttggacgcgttcccctcctgcacgcaacctcatctcgtcctcnanatccaggatggccgtcctccttgagaccttgcctccccgagtgctctcggtgagctactttgtttgcatttatcaggaaatccgtttgcttcatgttgtgcaggctcatatctgattgctggattcggcaaacccgcgttggatcctgtatcggttagtccttgcctgcaaggttcttgttgttttgtnttggtggtcgagcatcgcatgttctgcttctggatccagatctggagaaatcgcgaat

SEQ ID NO: 5491 - DNA, 296 bp, Zea mays
  misc_feature: Incyte ID No: 700350246H1
  unsure 26: a, t, c, g, or other
gtaaggcaagatgtacaccgcgaggnagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgtaaggccttcaggaagatccatgtcaggatcgtcagggagctggagaagaaattcagcggcaaggatgtggtattgt

SEQ ID NO: 5492 - DNA, 301 bp, Zea mays
  misc_feature: Incyte ID No: 700350248H1
  unsure 47, 191: a, t, c, g, or other
cgaagtggcccgcccaggaaatggcgtcgatgcagagctggcgcaangcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcngcgacatccatcgccaggcctagggcggatgtcgcctactgcatccacgctcttgcccgccgtcttgccaagacccgcaactggattgttgctctgaaagcacttgtagt

SEQ ID NO: 5493 - DNA, 306 bp, Zea mays
  misc_feature: Incyte ID No: 700350249H1
  unsure 12, 41, 102, 153, 155-157, 159, 162, 178, 180, 189, 297: a, t, c, g, or other
ggagcacaaganccaggagagtgggaaaatgcacgcttgcngacacgacgtgcacacgacaatgcttctgggggctgccagaatactccaggatcgcaagancgacctaatggtaactgatgcttaattaacccggtcaattccacacagctncnnngnganactccacgttcccatncntatgccgtngacgacgtgttcttgcttgcttcttgtgtcaccatgcagggcaccgtgaagcttgtattccagccggcagaggagggccaggcggcgcgtattacgtgctgcaaaaanggtcttgac

SEQ ID NO: 5494 - DNA, 302 bp, Zea mays
  misc_feature: Incyte ID No: 700350251H1
cgattcgttgccgtccacttgtctcacggcctgtcgccatctccttcctggttttttcatccgaccatccccggctcctccgcgccgtcgggacgactccatcgagtcactcggccgcagcaaccggcgaccatgtaccgagtcgcctctgggctcggcgccctcaagaggcatggggcaaatgctcaaatgatgaatgctgcaattaggtgtgccagcacaagtgttgcacagaggtcttccggtggcttctggacctggttgactggtgcgcgttcaaatgaaatacctcctccagattt

SEQ ID NO: 5495 - DNA, 301 bp, Zea mays
  misc_feature: Incyte ID No: 700350254H1
  unsure 209: a, t, c, g, or other
acgggaagcccgagaaatgagcagatcgccaccaccacctgccaaaaataaccgcagttcaccacgggaagcccgagaaatgagcagatcgccgccgccaccacctcccagaaataacagcaggtcaccaccgggagctcgagatgtgagcaggtcgccgccaccacctcctgatgccagaagaagctatagcagatccccagaacagncagccccagcacgagtccccatatgcccaatgacgcctgagaattttagctgctcaaagatgctggaaaatgctaaggggcccagcatgttt

SEQ ID NO: 5496 - DNA, 292 bp, Zea mays
  misc_feature: Incyte ID No: 700350256H1
  unsure 234, 266, 273, 291: a, t, c, g, or other
ctaccatgggcttcttccctgtagaccaagtagcattggactatctcaaactgacaggccgaagcgatgaaactgtgtctatgattgaagcatacctgcgagctaacaaaatgtttgtggacaagcatgagcctgagacggaacgcgttttctcttcacatctggagctggaccttagtgaggtggagccttgcgtttcaggccccaaaaggcctcatgatcgtgtcctttganggaaatgagtcagatggcatgctttcctgganaacgaantggctttaaggggttatng

SEQ ID NO: 5497 - DNA, 293 bp, Zea mays
  misc_feature: Incyte ID No: 700350257H1
  unsure 7, 14, 40, 62, 142, 212, 221, 241, 261, 278, 285: a, t, c, g, or other
ctcccanaagtganaaacaactcattgaagaatggaaganagcagggcctcgtccaagaccnctgcctccacctcctgcaaggccattactatgcacatgagaaggaaggctggtatggttggattggtgagaatgacacanaaccggaggcttcactgattgagttcaggaggcaagcacatcggttgctctgggatgcacttgattattnggtttcgtngaactgatgccttcttcccngggtttcacaacgccgggantggttggccagactacncaagttnggaagggg

SEQ ID NO: 5498 - DNA, 225 bp, Zea mays
  misc_feature: Incyte ID No: 700350258H1
  unsure 5, 14, 20, 27, 45, 52, 63, 69, 85-86, 127, 131, 134, 150, 156, 159, 161,: a, t, c, g, or other
tatcntaggagctntcagcngtatcancactatcattagtatatnacccccngcgatgacgcnatatcngaacacctctctttgnntgatccgtactaattacagccgtcctactagttctgctcantgcnagnattggcagcaggtatnactatnctncnttacngancggantctaangactactntnttcgaccccgctggnggtggagncccntttcccga

SEQ ID NO: 5499 - DNA, 103 bp, Zea mays
  misc_feature: Incyte ID No: 700350259H1
  unsure 43-45: a, t, c, g, or other
ctacggtatatttgtatcggagtgtaacgcactgttgtatttnnntttttgggtttattacagttctgaccttgttgaatgtaataaacccaaaaacaaaaag

SEQ ID NO: 5500 - DNA, 291 bp, Zea mays
  misc_feature: Incyte ID No: 700350260H1
  unsure 275, 282: a, t, c, g, or other
ctggaagggttttgattcgcatgaaggacaggttttcaatgctgttcagccgagatgctgactctatgcccagggtgtggacaggaaaggaggacataaaagctataactaaaaccgctcgctcagcttccatgaagttgctttctacaatggctgcaattcggttggaggaggatggtgataacattgagaacactctttccgttgctcttgttgacacctcaaaacctgggactactgataggagtatccattgacggatccattgcccccanttcaggnaaggggttg

SEQ ID NO: 5501 - DNA, 295 bp, Zea mays
  misc_feature: Incyte ID No: 700350261H1
  unsure 65, 179, 275, 282, 284: a, t, c, g, or other
aacggagattccttgcccccttttcccttccccatcgtcgaaaccctagccccgcctccgccgcnggcacgccggatcggtcggcgccatgtccaaggccagggtctacgccgacgtcaacgtgctgcgccccaaggagtactgggattacgaggcgctcaccgttcaatggggtgagnaggatgactatgaagttgtcaggaaggtcgggagaggaaaatacagtgaagtatttgagggtattaatgttaacaataatgagaaatgcatcttangatcctnangcttgtaaaga

SEQ ID NO: 5502 - DNA, 298 bp, Zea mays
  misc_feature: Incyte ID No: 700350263H1
  unsure 297: a, t, c, g, or other
gacgagtccaaggaggggatcgatggcgagttccaggagaagaaggctgatctccagcccaaggtcgtcgagatctacgagtctgcccctgcaccactcaaggtcctgatcaaggagaggagcaaggtgtccgggatcaagaagaactccgccgcaatcaccaagttcttcgaggagctggccaagatcgaattccctggagccaagcaagtgagcgacggcatctccaaggccggcccggcctgctgtccggccccatcttcgccagttcgagaaggtctccacgctgctcctgtng

SEQ ID NO: 5503 - DNA, 300 bp, Zea mays
  misc_feature: Incyte ID No: 700350264H1
  unsure 11, 42: a, t, c, g, or other
gtggccgtgtngttccagaaccgccgcgcgcgttggaagacnaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaattgctggcgcacagctcaaggacgacctgcaagcactgcggttgcatga

SEQ ID NO: 5504 - DNA, 303 bp, Zea mays
  misc_feature: Incyte ID No: 700350265H1
  unsure 80, 173: a, t, c, g, or other
ggcaaggttggcccgatcactcctcttccggacctggtgaccatccacaccccgaaggacgaggacgagccgcgccctcnggtcttggcacctcctgaggtgtaaggtcccaactgtgtccttgaaatggcagtttgatcgggtcctagataggtttctatcttacgataagnccaatgctaagacagttggttacccttaatcttatggacagatgctatgtgttgcttctgtggcattttgtttaagctaagttttgcggagacaagatacttatatatgttccggatgaattatggttcc

SEQ ID NO: 5505 - DNA, 292 bp, Zea mays
  misc_feature: Incyte ID No: 700350266H1
  unsure 145, 226, 284: a, t, c, g, or other
cactgggcaggcaaccatcatgggtcctcctgatagtccatatgctggaggtgttttcttagtgaacattcatttccccccggactaccctttcaagcctccaaaggttagcatcactttattatagagttaaattttctttcgnttttgttttcttattggaagatgaaaagtgttgttctgtcagtctacgaatgggtttctagctgagttggttaggtggccnattagtactcctgaagtctgggtttgaccctcatgagaggagttaggctggaggtacnaaaataat

SEQ ID NO: 5506 - DNA, 295 bp, Zea mays
  misc_feature: Incyte ID No: 700350268H1
  unsure 31, 92: a, t, c, g, or other
cagtgggtgaccctgtctctgacggtctganccgtcgcctccctctccccttgacgtgcgggtgcggctcctcctcgccgacggcgccagcnccgcctccctcgccctctcggcatagaccggcgacggtagctgcatcttcgagtccgcagtgaaaactagaagggaagaacagcctcctaatggataggaacaacgaactggaagaggtggtcccaaatgactcggaccctcttattgggagggataacagggagtcagagtcatcagtagagatgtcaccgcacagccagca

SEQ ID NO: 5507 - DNA, 192 bp, Zea mays
  misc_feature: Incyte ID No: 700350269H1
  unsure 5, 28, 80, 115, 150, 172, 185: a, t, c, g, or other
ccggnaccccacctccgcagcaactgcngctgcggcgggcaatggccacgacactccgcagcaaccgccgctgcggcggnaatggccacgacactccgcttcgccggtggacgcnctcttcctccagaactcatgacccgcgtccagtcngcgcgccttcctcgacaccaantcattcctcactnaggactt

SEQ ID NO: 5508 - DNA, 294 bp, Zea mays
  misc_feature: Incyte ID No: 700350270H1
  unsure 51: a, t, c, g, or other
aacgtaggctggcgctgcagatcaaaaggctctcgcctcggcttggcagtnggcactccctctccaccgcgctgcaggggcgacgcaaggccgagcgctcctcgatccagatccaaggtaggagatggctctcacgagaatgtcgcctcgccggcctcgcggtcatgggacagaaccttgccctcaacatcgcggagaaagggttccccatctcggtctacaacaggacaactccaaggttgatgagaccgtgcagcgtgccaaggtcgaaggaaacctcccagtgtttggttt

SEQ ID NO: 5509 - DNA, 290 bp, Zea mays
  misc_feature: Incyte ID No: 700350272H1
  unsure 248, 273: a, t, c, g, or other
ctgaggctatgaaaaaggttgggcggcagggagtggtcacacttgaagaaggaaagagtgctgaaaataacctctattctgttgagggaatgcagtttgaccgtggctatatttctccctactttgtgactgacagtgaaaaaatgacagtcgaatatgagaactgcaagcttctccttgtggacaagaaaattaacaatgccagagatcttatcactatcctggaggatgctattagaagtggatanccattcctaatagtggcagaggacntgagcaggaacctcttc

SEQ ID NO: 5510 - DNA, 294 bp, Zea mays
  misc_feature: Incyte ID No: 700350273H1
  unsure 49-50, 52-53, 55: a, t, c, g, or other
aatgaaggtacaagctcaaatttttttgacacaagtgcgaaactaacanntnncnaccagccaacaatcaataaaggtaaacaagttcagcagtataacttttttagcacccagatataatgatgctgatcccccaaaatacttcaaagctgctgatgggaggcctgccagttataaccaatttctttaccaaggtcagaatagttcagctggatggattgcacgaagtcctctggaaccttctgttatcaataattttgctagagttgaccgtccacatcattcgaatctggg

SEQ ID NO: 5511 - DNA, 293 bp, Zea mays
  misc_feature: Incyte ID No: 700350274H1
  unsure 2, 13, 256, 262, 279, 285, 292: a, t, c, g, or other
anggaaccgagtngccccggcgacgcgaggccgaggcgagctaatctgacggcggcagtggacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcattggtgtcacaacatctcttctattggaaaanccccanggagcagaaagccatanttattnttgtgcng

SEQ ID NO: 5512 - DNA, 289 bp, Zea mays
  misc_feature: Incyte ID No: 700350276H1
  unsure 226, 256, 259, 267, 273, 275, 283: a, t, c, g, or other
ccggaacagagcgaggcgacgccgagggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatgtacactcctacaagtactctggcttagcaaacaagaaaactgtaacgntccagccagctgctggaaaggatcggctgnggnctctctantaccangnccagaggnagaccc

SEQ ID NO: 5513 - DNA, 288 bp, Zea mays
  misc_feature: Incyte ID No: 700350277H1
  unsure 263, 281, 284: a, t, c, g, or other
gaaaaaagaaaagaagggtcttctgagcaggttctggggttgaaagatggcatatgcctaggattttggtacattgtcccatcatttgatatgctttgtgcatgaacggtgtaaaactagaatgtcctgataatacctctctgatgggtgaaagatcttcagtatcccgcccaaggatttttgagattctttatcagaaggttaatttagccgttgcaaagtacatctagctcggtgactgatcagcataaccttttgctgtnactaaattttgagcatgncgntttc

SEQ ID NO: 5514 - DNA, 286 bp, Zea mays
  misc_feature: Incyte ID No: 700350278H1
  unsure 221, 229, 231, 244, 248, 253, 270, 281, 285: a, t, c, g, or other
gaatgcaagagtgctgtgagcatctccgtagttggtggcagtgccagcattggtggcagcggtggcatcggccttggcctgggtagcggttttggctctggttcctgttctggaagtggcttcggatttggtggcggtatttatggcagctctggtaccaagatcacctcttccgccaccatcaccaagagatccccacgatagacaagacaggatcctgntggccttnanccctgatactctngtgnacctncatttacccccatcccnattttctttcngggng

SEQ ID NO: 5515 - DNA, 298 bp, Zea mays
  misc_feature: Incyte ID No: 700350279H1
  unsure 9, 18, 21, 34, 39, 63, 66, 87, 133, 138, 144, 149, 167, 171, 204, 206, 213,: a, t, c, g, or other
ctagctagnatgtacgcngtnccccaacctctgncgtantcttgttcatcttcgatctcctcnatntcccttgttcctctctctcgntgtttgaggagaactgcctgcaccctgctccctcttccgctcctcnccgcncgccgntcgcnatccccagacttcatttnaggncgggatggacgactacgcccgggagatgatggngntcaagangntcntnacccgcaccctcganannaagggcgtcctcgncaanattagggctganctaagagcaagngtgtttnaagcnattgaa

SEQ ID NO: 5516 - DNA, 299 bp, Zea mays
  misc_feature: Incyte ID No: 700350280H1
  unsure 39, 57, 69, 81, 93, 95-96, 99, 113-114, 121, 208, 215, 260-261, 267, 279,: a, t, c, g, or other
atgatttattacaatcatctcctcaatagccacactatntattttatttcaattaanaatttcttcccnagcctttcctgnacctccctcacncnntcnctatagccacagannaaacgantaacccttgagaatcaaaatgaacgaaaatctatttgcctctttcattacccccacaataataggtctaccaattgttgtgaccatnattatgntcccatcattctattcccatcatcagaacgcctaatcggaaccgnntacaancatttcacctgnanaatnagcttnancatcaa

SEQ ID NO: 5517 - DNA, 299 bp, Zea mays
  misc_feature: Incyte ID No: 700350281H1
ggcaggggggagaggggaggggaggggaggcattcgtgctccttttttccttcctactgtacgagtacaggactgcgctgcctgtctctcctcgcctgctgccgacttcgcggcctcgtcgccctgccatgtccaccatggacgaaggctacgggcctacttgggacagcgacgacgaatacgacaacttcatacgcaagatgaacccgccaaggatcgtcatcgacaacgagtcctcggcggaggccacaattgtaagggtagatagcgcgaatgaatacgggatattgctggaatgg

SEQ ID NO: 5518 - DNA, 295 bp, Zea mays
  misc_feature: Incyte ID No: 700350282H1
cgcacacagccaaaccatcctcctctccgccgcccgccgcagcagcacccaccgggcaagatgaagacgatcctggcgtcggagagatggacatcccggagggcgtcatggtcacggtggccgccaagctggtcacggtggagggccccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaacc

SEQ ID NO: 5519 - DNA, 291 bp, Zea mays
  misc_feature: Incyte ID No: 700350285H1
  unsure 6, 40, 54, 65, 67, 200, 221, 230, 238, 261: a, t, c, g, or other
ctcgangctggcgatcaatctactgcatgcctaagcgacnagctttcaaggganctgctcctatncnacctttcggatcgtttgaatcaagtgcttcggtgggctcttggttccattgaaattcttttcagcaggcattgtcccatatggtatggctatggaggtcggcttaaattcctggagagatttgcttatatcancacaacaatttatccactcanatcaatccngctcctcntgtactgcatattgccagcagtntgtcttctcactgggaagttcatcatccca

SEQ ID NO: 5520 - DNA, 287 bp, Zea mays
  misc_feature: Incyte ID No: 700350286H1
  unsure 282: a, t, c, g, or other
gttggagcaagcattgcagttctggaagcaagagtttatcaaaggaaagatggacccagacaagtttgataaaggttactgcttacaatatccgacatagctttggaaaggaaggcaagaggacagactatacgccattcagttgcatgaagattatcctgaccaacccaccaagccagggggatttccatgggtgcccattccgtcacagtgatgcagagctgctgaagcagaagatgcagacctacaagatccctgctcggggatcagccagattttggnttggt

SEQ ID NO: 5521 - DNA, 288 bp, Zea mays
  misc_feature: Incyte ID No: 700350287H1
  unsure 2, 111, 159, 239: a, t, c, g, or other
anccgcagagggactttttgtgtaaaatgcggtgggaaggtgcgctgcactggcaagcagaggtgtgctctactgacagagtttgaactctcaagaggaggcgaggcaganccgcaatcgcgaccgcgacccgcaggtgacatacatacggtgcgagcnccggaagccggaagcaccggtgacgaagccttccgtgtcatcactcatcaggatctcagggttttgtttcgtttcgcggntttgggaatccatccatggcgaggaagatgctcatcgacggggaggtgg

SEQ ID NO: 5522 - DNA, 286 bp, Zea mays
  misc_feature: Incyte ID No: 700350288H1
  unsure 246: a, t, c, g, or other
ctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagtggcggaggatggctactctggcgtggaggtgcgcgtcacgccgatgcgcacggagatcatcatccgcgccagcgnacgcagaacgtgttcggcgaaaagggcccaagatcgggat

SEQ ID NO: 5523 - DNA, 211 bp, Zea mays
  misc_feature: Incyte ID No: 700350290H1
  unsure 30, 41, 57, 60, 77-78, 92-93, 95, 98-100, 103, 112, 114, 116-117, 167, 200,: a, t, c, g, or other
gctagtattaaacaacgaatgtaagatagngaactttctgncttctatgtcattgcnttnagtatcaaggctgcatnnagaaaggatggcanncntgnnnccnccttacttncnanntcctttcccaatagagcagtctttctgtcctgctctctgctgcccctccnaatagtacatgtacccaggctggttcttgggcnagnnagtnggg

SEQ ID NO: 5524 - DNA, 284 bp, Zea mays
  misc_feature: Incyte ID No: 700350292H1
  unsure 279, 282: a, t, c, g, or other
ttattcgataaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtcttgcctgcaaggttcttgttgttttgttttggtggtcgagcatcgnatntt

SEQ ID NO: 5525 - DNA, 268 bp, Zea mays
  misc_feature: Incyte ID No: 700350293H1
  unsure 192, 203, 219, 221, 227, 236, 250, 259-260: a, t, c, g, or other
gctttcctttcctgcagacaagctgtaaatctcgcctagctcgtcgtcggagaccaaggagaagagcaagggggggcgcagaggcttgctggcttgctgcctacctagctcgtcggggccctatggagatccagcaccaccgggggctgggcaactccaaggttgtcaaggtgcagagcgaggaggcgtggnatctgttcacngatcaagcgagcaagnanggccgncctttgttnccatttgggggctnatggtgcgnnaccccctg

SEQ ID NO: 5526 - DNA, 291 bp, Zea mays
  misc_feature: Incyte ID No: 700350296H1
  unsure 44, 287: a, t, c, g, or other
atccaggtcgcggcgctgcacggcgtctccgcgaggcccggggnccccggcgagaccggggtgtgggtcggggaccgcaaaatcggcgccatcggggtcaggatctcctccgggttcacgtggcacggtctggcatttaacattgaccccgacctggagtacttcgagcacataatgccatgcggcatcgccggcaagggggtgacgtcgtgcggcgggaggtgggggacggagcggactcccggccgacggggtcatccacgaccagctcgtggggtgttggcganaatt

SEQ ID NO: 5527 - DNA, 188 bp, Zea mays
  misc_feature: Incyte ID No: 700350301H1
ccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagagg

SEQ ID NO: 5528 - DNA, 303 bp, Zea mays
  misc_feature: Incyte ID No: 700350303H1
  unsure 288: a, t, c, g, or other
gcccgatctcgcggtgctggtagcggtgaaaatatctgagatcgagtgaagctagcttttcatcgatatggcgcttgtactgcatgctggcagtagtaacaaaaatgcattcaaagcactaattgccgcggattacagcggcatcaaggttgagttggtaaaagactttcaaatgggggtttccaacaaaacaccagagttcctcaagatgaaccctattgggaaggttcctgtccggagacacctgatggtccgtctttgagagcatgcattgcaagatagttattncctgaaggcaacaac

SEQ ID NO: 5529 - DNA, 183 bp, Zea mays
  misc_feature: Incyte ID No: 700350304H1
  unsure 3, 6, 33, 46, 74, 81, 84-85, 90, 121, 154, 163, 165, 168-169, 173: a, t, c, g, or other
tanganaccagagcaaattccggcgagccggtncggtgcggcggangaggccgagggagacgccggcgcgaganggagcanacnngaggnggcagcggagatggatccggactcggtgaantcgacgctctctaacctggccttcggcaacgtnatcgccgcngncgnncgcnactccaaaag

SEQ ID NO: 5530 - DNA, 302 bp, Zea mays
  misc_feature: Incyte ID No: 700350305H1
  unsure 267, 286: a, t, c, g, or other
gaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaattgggcctaattttgggcntcctgaaatgtttcctgcncgccaaaacaaaattt

SEQ ID NO: 5531 - DNA, 301 bp, Zea mays
  misc_feature: Incyte ID No: 700350306H1
  unsure 73, 95: a, t, c, g, or other
gttagctgactggtgagggtctggatctagcaatggcggaaaacacccacggtagtggtccgccacgtgcttngggacttgacaaatgttatttncaagcgagcagccacatcagatctggagaagagtacaggtgggataaagatcagacggattgaaaagactgggactaggaaagagtacgatgcaaatgcaaaagctagcagtattgggaaaggaattgtatttggccatttgtttgatgatgttgccagagagaatttcaaagccattcatctttcagaatagtagggtccacccc

SEQ ID NO: 5532 - DNA, 118 bp, Zea mays
  misc_feature: Incyte ID No: 700350307H1
gggtacaccgggaaagaaattgggtgtggtttaaatttatccgataatttaacatgtgctgtagcctgtgaaagacaatttggtttgccagcgtcgtttgatcattcattccttttct

SEQ ID NO: 5533 - DNA, 222 bp, Zea mays
  misc_feature: Incyte ID No: 700350309H1
  unsure 219: a, t, c, g, or other
gtttttgctcttcactatccgatgcccaccaatctaagcagccaaggcatgcatacctaatcttctcgaggacaattcaggaggtttgcttttttcctccctgttttatactggcatactactatatacttcattgatttttttagcagggtaaaaaaatataaagatagatttttagaaaataacatatagttcataaaattatttcagctgatgaancct

SEQ ID NO: 5534 - DNA, 232 bp, Zea mays
  misc_feature: Incyte ID No: 700350311H1
gagttctttcgtggaggaagcgggtgcaactggaggagggtagaggtagctcaatagatctactgctgtcgggggagttaatgcaaagctgagttgctgcacgttggctttcttcagagatggcttcagctggtgtagccccatctgggtacaaaaacagcagcagcactagcattggtgccgagaagttgcaagatcagatgaacgagctaaagattagacatgataagga

SEQ ID NO: 5535 - DNA, 294 bp, Zea mays
  misc_feature: Incyte ID No: 700350312H1
  unsure 2, 53: a, t, c, g, or other
cngaaaccgagagctagtgcttgattcggtcgtttttgggcaccgaacacgtncttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccattcaatccttaccgtgtcatcaggacccatcttcttctgctgatgcac

SEQ ID NO: 5536 - DNA, 292 bp, Zea mays
  misc_feature: Incyte ID No: 700350313H1
  unsure 19: a, t, c, g, or other
ggcggcggcaccggcaggnggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccatgagaatccgcagacattatcgtgcatctgctaggccctatggccagagggctgtcctcaagtttgcgcatacatgg

SEQ ID NO: 5537 - DNA, 236 bp, Zea mays
  misc_feature: Incyte ID No: 700350314H1
  unsure 74, 76, 173: a, t, c, g, or other
gaggcaccacgcccccacccgagcctgtagggtgagtcggcttcttcccaccggcaacacgtctccgctggtcncnttccatcaccatcgctggtccctctccgtgcggttcccctccgccgtcactggacctcgtcgtgagttcgtgaccgctgataccagtcccctacgcngccgtcgtccctacgccgtcgtcctcctctacatcgccaacccttaaggattcaactgtatca

SEQ ID NO: 5538 - DNA, 300 bp, Zea mays
  misc_feature: Incyte ID No: 700350315H1
  unsure 13, 17, 57, 64, 67, 69, 75, 106, 108-109, 115, 164, 207-208, 219-221, 229,: a, t, c, g, or other
cgatgcgtctgtncgcncacatgtgccatggaacgccggtccctggacggcgatttnaactccnatncnatcgtngccgtgctgcggtccatgtacccgtgcaggngnnctaaantctcggtgagcaggtacacgctctcgtcgtcaagaaaggcaggatccanggtgacattggcagctcgctagtgcagctgtactgcgatgganncggttttcacnnnagcgcgcngcgagttctcgcgacgacgatgcagcaccatgtnaggaaccagtccctgaggctgcctggacgagcngata

SEQ ID NO: 5539 - DNA, 222 bp, Zea mays
  misc_feature: Incyte ID No: 700350316H1
gtctaactgagcctctatgggattcttcatcagtaccatatcaatatacggataatgccatgtttgttcgagattacaccataaaactcttaggaacatcatttcctaacatgactgtagctgaggtgaccaagtttgtggatggcctcttagttcaaaacttgatcttccgagcttcaaaaaccatattagagatttccggtgcagtcgaaggagttctca

SEQ ID NO: 5540 - DNA, 182 bp, Zea mays
  misc_feature: Incyte ID No: 700350317H1
  unsure 76: a, t, c, g, or other
gctcccagcactgctgcacagaatctaggctcagagcttgagatctcaagatgggagatgaggagaagcgcaacanggccattcacggcccggagacagcacctgaagagtgtgatgctccagatcgcggccacagagctggagaaagaggaaagccgccgcgaatccgagaagcagaatac

SEQ ID NO: 5541 - DNA, 224 bp, Zea mays
  misc_feature: Incyte ID No: 700350318H1
ccttgatgatgagacgcaaaatcgcaatgatcaggggtttgaaaaaatgatatctgggatttatcttggggaaattgcaaggctggtgctgcatcgaatggctctagaatcagatgtcttggtgatgccgctgataatctatccacccccttcacattgagcacaccacttctggctgcaattcgcaaggacgattcaccagactgagcgattcaaaggttttc

SEQ ID NO: 5542 - DNA, 233 bp, Zea mays
  misc_feature: Incyte ID No: 700350320H1
tggagacaatcacatgagaatcatccaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcatggaattccaaaagagtttgacgctagatctgcaggt

SEQ ID NO: 5543 - DNA, 246 bp, Zea mays
  misc_feature: Incyte ID No: 700350321H1
  unsure 69: a, t, c, g, or other
cctgcgtcccctgcccaccatggccacccaccgcctagtaatggtccgccacggtgagagctcatgganccaagagaaccgtttctgtggctggtttgatgcagaactgagtgagaagggggcagaggaggccaagctgggggccactgccatcaaagatgccaagatagagtttgacatctgctacacgtcggtgctgaagcgggctatccgcaccctttggaccatcctggatgttacggacca

SEQ ID NO: 5544 - DNA, 299 bp, Zea mays
  misc_feature: Incyte ID No: 700350322H1
  unsure 2, 4, 232, 279: a, t, c, g, or other
tngnaaaaaaggttctacgaaacgtgcatcaaagccttctcaaaacagtaaaaatgagcctgaggtagagataaaaaaggttggcaagagagaaaagagttcaaaagaaactgacgtgtcaccagattcaaataagtcaaacaagaagatttctaaatccaaaaagggtgatggaaaagaaacccaaaacaataaagctgccaggtcatccaataagagtaaaggtaaagtncaaaggtgggtcatggctgggactgccccaaccactgaacagcttcnatgctgttgttagtggattt

SEQ ID NO: 5545 - DNA, 220 bp, Zea mays
  misc_feature: Incyte ID No: 700350323H1
  unsure 43, 169, 188: a, t, c, g, or other
caagcaggcagcagccgatcggactcggctagtttcgccggcngcctccaactggtcctccgctgggcgcgagggctctttctctaggcccgtagatctgcgctgctgcgccctcgttgtcgtgaaaatcactatccgtctcttggatcgagcgatcctcccattcgcngcttcgccccacacgagtngttccaaggagccgaaatttccagcccgcccg

SEQ ID NO: 5546 - DNA, 287 bp, Zea mays
  misc_feature: Incyte ID No: 700350324H1
  unsure 243: a, t, c, g, or other
gttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtctgttgactctactatctgattatcattgtaagcgattgncccaagttatttgtcgtttatgataattgctttcctcaaaaaaa

SEQ ID NO: 5547 - DNA, 214 bp, Zea mays
  misc_feature: Incyte ID No: 700350326H1
cgaatgcatacatgagctgatctgcagcgggaacaagttccattcgtgtgtttttcacccaaattacccgaatttgcttataatcggttgttatgagtccctagagctttgggacattagggagaagaacacggtgacaatcagcaacgctcatgacggcatggttgctgccctagccgcgtcaagtgcatcggggctggttgcatcatgatca

SEQ ID NO: 5548 - DNA, 291 bp, Zea mays
  misc_feature: Incyte ID No: 700350328H1
  unsure 30, 87, 104, 112, 136, 218, 234, 253, 255-256, 261, 263: a, t, c, g, or other
ctccctccgcatccactgccaccatgagcngcgatcgctacttccaccgcctgcctcgacctccacctgccacgccaacgacgaccncttcttccccttccctncccctgcntcgtcctgcccctacatcaccgcntcctccgcccaccaccgcttcctcctcgacgaccaccccttctacccaacctcctgcccgctcggcatcacctcccgctccncgatcgacgacacttngactggattctcttccccntnnccttnanggcggcggtttcggggccccgtgcgcgg

SEQ ID NO: 5549 - DNA, 292 bp, Zea mays
  misc_feature: Incyte ID No: 700350329H1
  unsure 258, 260, 267-268, 272, 281: a, t, c, g, or other
acaaagcttcagatcatcatcctgtaaattcaactacccccaaatgcaaaaccatttctggtgacaactcaaagactctaagaacccccccatgtgcattgcctggtattggcttgcacttgaatgcccttgccgcaactgcaacacctaaagagaaaatagtccctcaagacattcagtctactataaatgaatcaagtaacttgataggccctgctggatcttctccggaacttctgagcaaaacttataaatgangntttcatnnaaanaatgatgtngcaaccgctga

SEQ ID NO: 5550 - DNA, 173 bp, Zea mays
  misc_feature: Incyte ID No: 700350330H1
  unsure 14, 18, 95, 113-114, 117, 129-130, 137, 147, 150, 172: a, t, c, g, or other
gccgcccgctcgcncgcntccgctccggcagcgagctctatctcccgcgacgagcagcagctgccaccgacgcacgctcaccgggcaataaatantggtattggtagtgtganntcnataagaagtcannatggtgnagttcacagntgnagagctccgcgctatcatggana

SEQ ID NO: 5551 - DNA, 244 bp, Zea mays
  misc_feature: Incyte ID No: 700350331H1
  unsure 14, 35, 53-55, 57, 61-62: a, t, c, g, or other
ggctttgctctgcnaccatgagctccctgtacgangtctcctgcttcgccgcnnncnttgnnggcaacgtccttcgccctcgccctcttcctgtcgccggtggatgcaccgctgacgaatgcgttgctgctgctgctcgcctgctcctcgctttctgcacgccgtcctccaggccgacgttcaagagggtcctcaaggccaagtcgacggagcagttcgatgggctgccctacctgctgtcctg

SEQ ID NO: 5552 - DNA, 176 bp, Zea mays
  misc_feature: Incyte ID No: 700350332H1
gggaagcaaagtcaaatacgagcttgacaagaaaactggactgattaaggttgatcgagtcctttactcatcagttgtataccctcacaattatggtttcattccaaggactcttgtgaagacaatgacccaatggatgtgttggtcctgatgcaggagcctgttgttcctggttc

SEQ ID NO: 5553 - DNA, 172 bp, Zea mays
  misc_feature: Incyte ID No: 700350334H1
gcaccaagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcagcgtcggg

SEQ ID NO: 5554 - DNA, 266 bp, Zea mays
  misc_feature: Incyte ID No: 700350335H1
  unsure 10, 23-24, 31-32, 51, 84, 87, 89, 116, 145-147, 151, 180, 186, 214, 221,: a, t, c, g, or other
atcgctggantgcagccgccaanntgtagtnnaatcccttcgtagacttcngaccgatgcaagaaccgcaaacggcatttcaangcncnatctacacattcggaggaagatcatgncttctccgctttccaaagaactgagacannngtanaatgttcggtctatgcccattcgaaaggncgacgnagtttcaggttgttcgaggacactacanaggccancagatggnaaatggtcccagtgtacaggaaggaatcangtnatnt

SEQ ID NO: 5555 - DNA, 54 bp, Zea mays
  misc_feature: Incyte ID No: 700350337H1
  unsure 5, 27, 29, 46, 52: a, t, c, g, or other
agaangaagccccagcacgtcctgagncncaggccaggcgttctcnccgttnga

SEQ ID NO: 5556 - DNA, 231 bp, Zea mays
  misc_feature: Incyte ID No: 700350341H1
  unsure 104, 136: a, t, c, g, or other
ccgagagcgctccggaaatgtcggcgggtgagctgcggttggagctggacgagctgcggcggctggagagcctcgccaagcacccccgcgtccagatcctcctncgccaacgaaatccgcaacgttgaagcgaatnggcgaaggcaaccgaaccatcgcctgagccactggcggcggcttctgcgccaggcccgcgcccgctgcgctcctgttttaagctagtcactcttg

SEQ ID NO: 5557 - DNA, 286 bp, Zea mays
  misc_feature: Incyte ID No: 700350343H1
  unsure 83, 250: a, t, c, g, or other
aatagatcttgatatggagaatgttgataaatcaagtattaagaagaagaaaagaaaactagaactgaataaggccattttgnatgatgatcggttcaaagaaatgtttgagaataaggattttgaaattgatgaagaatcaaaagaatacctcgcacttcatcctgcaggcagccacaaaggagcctcgcctgattgaagaacattttgatagtgttagcgaggacgatcaacaatctgatggtaacanatctgacactctagcggaatctgacatgatgatgtc

SEQ ID NO: 5558 - DNA, 283 bp, Zea mays
  misc_feature: Incyte ID No: 700350344H1
gggatagcgatggaaaatccaggtgttttggatttgtcaattttgaaaatgcagatgctgctgctcaggctgttcaagagttgaatggcaagatattcaatgataaggaactgtatgttggaagagcacagaagaagtctgaaagagagatggagttgaaggagaaatttgaaaagaatgttcaagaggtagctgagaagttccaaaacacaaacttgtatttgaagaacttagaggagaccttgatgatgagaaattgcgtgaacccttgccgatatggcaa

SEQ ID NO: 5559 - DNA, 285 bp, Zea mays
  misc_feature: Incyte ID No: 700350345H1
  unsure 60, 97, 126, 195, 208: a, t, c, g, or other
aataattactctctcgagaacttgatgattgatccttatttaaacatattgggcattgcnacttgcgtgagcgttgattcaatatgtttaaataatnactctctcgagaacttgatgattgatccntatttcaatcggattacttctttgttgcacaattgcagtgaagatgttaatgaacttgatgttaaaccngatgggtcatggngtgtgatgggtgatgccgctaccagagatttatctcagtggcatatgcctgatggtactctttgtgactcaaaggaa

SEQ ID NO: 5560 - DNA, 289 bp, Zea mays
  misc_feature: Incyte ID No: 700350347H1
  unsure 256, 264, 270: a, t, c, g, or other
agctcagtctcttccactctcccttgacctgtctccttcacctgctgattgctgtgccgctccgctccgctccggtggcatctgcatctgcatctccatccctcgatctgtcttctctcagggtggaataagcgtgacaatggaggctccacccgtggcgctgttcgacaccctcaaggcagccaaaccgttcttcttgttggctggtcccaacgtgattgaatcggaggagcacgtcctgaagatggccaaacantcaaaggnatttangacaagcttggaattcgcc

SEQ ID NO: 5561 - DNA, 291 bp, Zea mays
  misc_feature: Incyte ID No: 700350348H1
  unsure 253, 276, 279, 285: a, t, c, g, or other
ctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacaganaggaaactgggaaggtcaaagcnttngctttngaaaaa

SEQ ID NO: 5562 - DNA, 187 bp, Zea mays
  misc_feature: Incyte ID No: 700350349H1
  unsure 6-7, 111, 161: a, t, c, g, or other
cgcaanngagcttcaatccccagaggccagagccagctgctcggcgctccacgcgatggcgcagaaggagaccaatggcagcaacggcgagcacatctccacccgcccgcngccgaccccgtcgcccctccgcttctccaagttcttccaggctaacctgnggatcctggtcactggtggggcgggt

SEQ ID NO: 5563 - DNA, 263 bp, Zea mays
  misc_feature: Incyte ID No: 700350350H1
  unsure 8, 245, 260: a, t, c, g, or other
ggagctgnaccttcctcttcccctcgttgatcgttcgcggttgccgattcgccatcccctccaaatcaagacaagattgagtgggtcttgggcccctgtccctagctgcattgcgaattgaggcgccaatttgggagacgactgcattgatgaatgccggaggccacagcactcactgatttagggattcgatgtcacgggcacccggatgtcatgccgatcgcccttgtagtcggaatgccgtngcgccacttgctcgnggt

SEQ ID NO: 5564 - DNA, 214 bp, Zea mays
  misc_feature: Incyte ID No: 700350351H1
  unsure 45-46, 98, 208: a, t, c, g, or other
aggctgtagatctttttagttcagcttctgaagaaatacaaggcnnaattgactacaggcatacttacctagatttctcaaaacttgaagtgaatgtnccgtacaagtacaggaagtcagcaagttgtgaaaacatgcccagcagccatggggtttgccttgctgcggaaccacagatggtccggagcttttgactttaaacaggagntgtccg

SEQ ID NO: 5565 - DNA, 287 bp, Zea mays
  misc_feature: Incyte ID No: 700350352H1
  unsure 168, 203, 217-218, 223, 228, 234, 238-239, 242, 246, 250, 255, 262-264,: a, t, c, g, or other
caagaacctcaagcttggcatccacgaggactccacgaacaggaccaagattgctgagctcctgaggtaccactcgaccaagagcggggatgagctgaccagcctcaaggattatgtgaccaggatgaaggagggccagaacgacatcttctacatcactggtgagancaagaaggctgtggagaactccccgttcttgagangctgaagaagaggnntatgnggtcntgttcnggtnnatnccantgangattnttctatnnnanacngagttttggaggnanacc

SEQ ID NO: 5566 - DNA, 217 bp, Zea mays
  misc_feature: Incyte ID No: 700350353H1
  unsure 22, 29, 31, 58, 65, 68, 74-75, 79, 85, 87, 95, 97, 102, 114, 129, 132, 143,: a, t, c, g, or other
ctcccggcggcggcgcaggagnagcaacncncgaagatggtgaagttcctcaagcccngcaaggncgngatccnnctgnagggcngnttcgccgncnggaangcggtgatcgtncgcgtgttcgagganggnacccgcgaacngcccctatggccactgcctcgtcgccgncctcgccaagtacnccaaganggtggnccgcaggncntcggcnaag

SEQ ID NO: 5567 - DNA, 281 bp, Zea mays
  misc_feature: Incyte ID No: 700350355H1
  unsure 205, 212-213, 228, 232, 234-235, 238, 241, 249-250, 253, 257-259, 264, 276: a, t, c, g, or other
gcgccgcggccggccccccggctccggcaagaagaagcagttcgaggccctgggttcctggggcatcgctttcacccctcacatcctcgccgtcaaggcaggcgaggatgttgcttcaaaaataatgacattctcacagcaaggccctcgcacagtctgcatcctctcggcgaatggcgcgattagcaacgttacgttcaacacnatccacnntggtggactattatngggngnnccnttnaaaaaaannggngttnnnttctnccggggggaaanaaccc

SEQ ID NO: 5568 - DNA, 285 bp, Zea mays
  misc_feature: Incyte ID No: 700350358H1
  unsure 60, 69, 88-89, 118, 149, 158, 160-161, 163-164, 166, 171, 186-187, 190-191,: a, t, c, g, or other
gcaatttcttggcacaagtttatgacgtgatctagtgagcattatgctactcagagtacnaaataaacnagtagattaccttttaacnntgtaataatggtgctttaaccaggaggantcaggccgtcccttgcccaaagtttggtgantgggatgtnanngnncnggttnccgaagagggtttannggnnatttncaaaanccccagatttgaaaagaggggtggaatggtaaanacangcccccttncaaggcccccnggntcgggggggctttctaanccaa

SEQ ID NO: 5569 - DNA, 286 bp, Zea mays
  misc_feature: Incyte ID No: 700350359H1
  unsure 15, 273: a, t, c, g, or other
cttccacgccgtcgncctggaaggagccttggctgatcagcatactatctttccatgccattctgctactggttaccatcatctcgaggaggaatatcaatttccagctcatcttgtcagctctaacattttctggtgtattccttgctgagagattaaatacgttcctggcgcaaaactggaagagcttctctacccaaaactattttgatccccagggccttttcattcggtcatctggtctggccctctcctcctgataacgatcttatncggtgaacactct

SEQ ID NO: 5570 - DNA, 288 bp, Zea mays
  misc_feature: Incyte ID No: 700350360H1
  unsure 255, 273, 283: a, t, c, g, or other
catagacctctctgttggtgattggatcaatagggactatgactattatgagtttctcacaccagacatgaagaatagctcacttcaactccagggtccatgctaccctataatatttccaactgtaaatgtctattggagctgccaatttattgcacgtgcatccaatgtttctttgaagcactggcatgagacgggtggtgtcagcattgatgaaaatatcctcattgataaaacagtgcacaaggccatcgnttctagatccgcggtttnaaggggattntggcg

SEQ ID NO: 5571 - DNA, 287 bp, Zea mays
  misc_feature: Incyte ID No: 700350361H1
  unsure 160, 169-199, 257, 267, 280, 283, 286: a, t, c, g, or other
gccaagctcgcctgatacgggtcccagcccgatccgcttgatttaggtctgcctgttggctatagcagcgtccagaggcgttgcgccgtgcaaggatcctcaatgtttgttgtgtgaacagagatacgcgtttgaatttggcataaagttaactgttgtncttcttttnnnnnnnnnnnnnnnnnnnnnnnnnnnnnnngatgggtatcttcaggtttcagtttgatgatggaataaggaaagatcattgtcgtatnaccgatgacnggatgattttaanaanttna

SEQ ID NO: 5572 - DNA, 292 bp, Zea mays
  misc_feature: Incyte ID No: 700350362H1
  unsure 273: a, t, c, g, or other
cattcctcgcgcggcgaccacccgattcgaagcgtgcggagagaccgaagaagcgggagagatggctcgtaccaagcagactgcttcgcaagtaccacgggagggaaggctcccaggaagcagcttgccaccaaggctgcccgtaagtctgcccccaccactggtggagtgaagaagccttcaccgctaccgccctggaactgttgccctccgtgagatccgcaagtatcagaagagcactgagctgctgatcaggaagctgcccttccagangctcgtcaggaattgcaca

SEQ ID NO: 5573 - DNA, 100 bp, Zea mays
  misc_feature: Incyte ID No: 700350363H1
  unsure 57-58, 69, 71-72, 77-78, 80, 87, 90, 93, 97: a, t, c, g, or other
atctcctcgcatttcttcccatccgatccccccttcgcaaccaaaaccccaactagnnccgcatcgatngnnctcanncnccgaganganacntgcngtg

SEQ ID NO: 5574 - DNA, 295 bp, Zea mays
  misc_feature: Incyte ID No: 700350364H1
  unsure 10, 123, 239, 245, 248, 250, 254, 263: a, t, c, g, or other
ggcgaaaggnaccatggattcctccggccggcggcggtggagcgcagatcaagggtatggcgacgcacgggggccgctacgtgctgtacaacgtgtacggaaacctcttcgaggtctcctccnagtacgccccacccatccgccccatcggtcgcggcgcctacggcattgtctgcgcggctgtcaactcgcagtcaggggaggaggttgcgatcaagaaggttggcaatgcgttcganaaccanatngncgcnaagcggacnctcagggaaatcaattgctgcgccacatggac

SEQ ID NO: 5575 - DNA, 288 bp, Zea mays
  misc_feature: Incyte ID No: 700350365H1
  unsure 32, 207, 223, 247, 249-250, 269, 275, 281: a, t, c, g, or other
gttttcttaccttacaagctttttcttccgcngccgcctcagccctcgccccgcgctgctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgcngccaaggtactggagnactgaagtggccattcacggtttncnncaagggaaaagtaacatgngagttntttggnatccggc

SEQ ID NO: 5576 - DNA, 279 bp, Zea mays
  misc_feature: Incyte ID No: 700350367H1
  unsure 37-38, 40-42, 82, 84, 169, 187, 189, 205, 216, 218, 220-221, 230, 232, 234,: a, t, c, g, or other
aagagatcaaatcctctccaaattccacacaacatannannnactagagagagtgatttgcttgtgttctttcgagctcttncncttggattgctttcttctttctgatcctttctttgcaatcaaactcacttgtaattgaggcaagagacaccaaacttgtggtggncctgtgggaatttgtgtncnaagtgattgagaaganaaagcccatcnancnnggatctttnananagggagggtnaaaaanccccgncntngngncccccnaaaggggna

SEQ ID NO: 5577 - DNA, 241 bp, Zea mays
  misc_feature: Incyte ID No: 700350369H1
  unsure 29, 33, 39, 46, 52, 65, 79, 207, 220, 225, 227-229, 235, 240: a, t, c, g, or other
ctcatcctgccgcactgccccattgtgtntgcnactctncgagtgncgcatnccttcgtcctttnccccttccccagcngccctgcttccccccctctcccggtcgcctctaacgtcgctggtgactcacgaagacctccatcgacggcggtgaaactggggccgacttctggagggtttgacttgttggatacagcgcggttcttnaaatgggggggtnctctnannnatttgnggggng

SEQ ID NO: 5578 - DNA, 279 bp, Zea mays
  misc_feature: Incyte ID No: 700350370H1
  unsure 31, 182, 203: a, t, c, g, or other
tcaaatgctacttgatcagctctttgacctncaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatcctatcaggggctcntcagcacctggacaacgatcntccctgcattcgggtaccatcatcaagctacatggatcagctgaacaacgaggactggtggacccgatgagctggt

SEQ ID NO: 5579 - DNA, 141 bp, Zea mays
  misc_feature: Incyte ID No: 700350371H1
  unsure 22, 37, 39-40, 46, 52-53, 57, 61, 127, 129-131, 137, 139: a, t, c, g, or other
agaaggttggatacaaccctgnataagatcaccttcnannccaganattggnncgantgcntcttatcagggttgtatccaaccttcttcaggtaggaaggggcttccttcctgttgagggttggtncnnnctgaananga

SEQ ID NO: 5580 - DNA, 188 bp, Zea mays
  misc_feature: Incyte ID No: 700350372H1
  unsure 38: a, t, c, g, or other
ttcttgagcaaagtgaacaaataatctcgatgcgaganagggaaaaatggatcaagattttagagagaagaacccaggatattaataaggaggctgatgagctaaacaagaagttggcgttaataccaagccggcaaaggatgcatgtgcctcggagatacaactgtatgaggcgcactgtgttgaag

SEQ ID NO: 5581 - DNA, 186 bp, Zea mays
  misc_feature: Incyte ID No: 700350373H1
gatccgtcgacgtcgacgcgttcagccagtgcagctccggtgtacaacatagagaaggccgggagctcgtactccgaagattacagctacagcagctccggtccggctaggaaaggcagctcaccgtatgcgtattcagcgtcgccgctggttggcctgcctgagctgtcgcatctaggtggggca

SEQ ID NO: 5582 - DNA, 280 bp, Zea mays
  misc_feature: Incyte ID No: 700350374H1
  unsure 270: a, t, c, g, or other
agctgcagttcgaagcagcatgggctctcacaaatattgcttctggcacttccagaaaatacaaaggttgttattgatcatggggctgttcctatatttgtgaagcttcttgggtctggtagtgatgatgttcgtgagcaggctgtgtgggcttgggcaatgttgctggcgattctccgaagtgtcgtgaccttgttctcgccaatggtgcatgatgcctctgctagcccagttgaatgagcagcgaactctcccagttgaggatgccanccggactctg

SEQ ID NO: 5583 - DNA, 279 bp, Zea mays
  misc_feature: Incyte ID No: 700350375H1
  unsure 246, 276: a, t, c, g, or other
gaagaagataaagctcacaggcacaccatgcaagatatttaagaagactgcactaatcaagggaatgttccacatccgatttagaggttgctaggtttgaaggtgctgccattcggactgtaagtggaatccgaggacaggttaaaaaggcagcaaagattgagccaggagatatgttgaagagaaaaggggaaaatacagaaggaatcgcaagatgtactttgaggacagattctatgagtgacntgttttcctgcgtgccgggtcacgttgaantcc

SEQ ID NO: 5584 - DNA, 285 bp, Zea mays
  misc_feature: Incyte ID No: 700350378H1
  unsure 243, 251, 275: a, t, c, g, or other
caaagacgggctcatccacaaggaggagttccagctcgccttgttcaggaacagcaggagagcgaacctctttgcagacagggtcttcgatctgttcgatctcaagcggaacggagtcatcgatttcgaggagttcgtgcggtcgctcagtgtgttccaccctaaagcagatacgtcggagaagacggcgttcgctttcaagctgtatgatctgagggggacaggctacatcgagaagaagantcagaganatggtcttggcgctgcttgatgantccgaccccc

SEQ ID NO: 5585 - DNA, 233 bp, Zea mays
  misc_feature: Incyte ID No: 700350379H1
  unsure 186, 195, 201, 204, 207, 209-210, 212, 222, 229: a, t, c, g, or other
gtagttcttcagttaggcaggagggcacaggaggaggaagatggcgtcgaagaggatccagaaggagctcaaggatcttcagaaggaccctcccacctcgtgcagtgcaggtcctgttggtgaagatatattccactggcaggcaacaataatgggtccatctgatagcccatattctggtggatnttcctagtnacaatntanttncnncnaattttcaanccaaaangggg

SEQ ID NO: 5586 - DNA, 263 bp, Zea mays
  misc_feature: Incyte ID No: 700350380H1
  unsure 94, 118, 187, 194-195, 205, 210, 219, 225, 231, 249, 260, 262: a, t, c, g, or other
gatgtctcgccgctatgacagccgcacgacgatcttctcgccggaggggcgtctctaccaggtggagtacgcgatggaagcgatcggcaacgcnggttcagccctcgggatcctagcngccgacggcgtggtctcgtcggcgagaagaaggtgacctcaaagctcctcaagacttggcgctccgccnagaattnnacaagatcgnctccnagtggtgtncgcgtngcgggnataatgtccgacgcaaantcttaaaaaancng

SEQ ID NO: 5587 - DNA, 233 bp, Zea mays
  misc_feature: Incyte ID No: 700350381H1
gcttagccggcagttgggcatcaagaactttgctccgctgaagcccttgtttcttgatctgcatatgggcagtcattcatatctgcgtgcccttgctgctgctccagttatatcagttgctgtagagaaaggttggaatgagtccgcaagtcctaatgtaagaggccctcctgcacttattttcagcttctcacaaatggaagacagactcaaggctgcctacaagccacact

SEQ ID NO: 5588 - DNA, 281 bp, Zea mays
  misc_feature: Incyte ID No: 700350382H1
  unsure 2, 274, 279: a, t, c, g, or other
anaggttatatcaaaggaggaaatctacaaggccactgtggttgacatgatgatgtgtgcaattgaggtcgactggagggatttcttcccgtacctcagctggattccaaataggaccttcgaaacaagagtactgactaccgaagcgaggagaactaccgtgatgcaagcctgatcaagcagcaaaaggaaagaattgcacgtggggagactaggatatcctacctggacttcctgctggcagagatacatgactgatgaacattactatggnggggngg

SEQ ID NO: 5589 - DNA, 284 bp, Zea mays
  misc_feature: Incyte ID No: 700350383H1
  unsure 32, 34, 152, 197, 217, 230, 236, 240, 250, 254, 268, 274: a, t, c, g, or other
tcttctgctcaacctccgcttccgtaggtgcngncgctaagcgaggatccctccgttcatcggtcccgacggcacctcgactccgtttcgtcggtcgctgtggcgacgggtgattgactgcgatatgaggcaatggttatgttgtaactgcnactttgatgacgaggaagatggccatgacaaggaacaggccaaanctcagagccaataagatagnccccaagcagaantcttanaaancccctgttanccanccggagcagtttcncccccnaaaaaattgg

SEQ ID NO: 5590 - DNA, 274 bp, Zea mays
  misc_feature: Incyte ID No: 700350384H1
  unsure 217-218, 222, 237, 241, 245, 252, 264-270, 272-273: a, t, c, g, or other
gtagccgcctcgctttctcctcttccgccccaccccggtgaggcgctgatccatacgcctcggacagcggctccagaacctccgcgttgcagaaacacagtagcgagaactattcggtggggccgaagatggtgtcgctgaaggtgccaaagcgcctcgccgcaagcgttctcaagtgtgggaaaggcaaagtgtggctgaccccatgaattatganntctngaggcgacctcccgncatnacancggaatngttaggtgggtnnnnnnnanna

SEQ ID NO: 5591 - DNA, 257 bp, Zea mays
  misc_feature: Incyte ID No: 700350386H1
  unsure 35, 37, 55-56, 177, 189, 192, 194-195, 201, 209, 218, 229, 245-247, 250,: a, t, c, g, or other
gtccgccgtcgtgcgctcgctacccctctccctcnangcctttgccggcgaaganngcccagtcgcccaccaggatgaagtttgttgctgcctacctgcttgctgtcctcgctgggaactccagcccctctgccgaggacttgacagccattctggagtcagttggctgtgaagttnacaatgaaaaanatncnnctcctnctgtcccngctgagcgntaaggacattnacgagctcatgcggcnnnaangtanaat

SEQ ID NO: 5592 - DNA, 283 bp, Zea mays
  misc_feature: Incyte ID No: 700350387H1
  unsure 281: a, t, c, g, or other
cctgcttcccttcctgcctgcacaccacatctcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcatcccaacaagccaatccagataaaaacaaaaggagcaacttcaacagancc

SEQ ID NO: 5593 - DNA, 127 bp, Zea mays
  misc_feature: Incyte ID No: 700350388H1
aaaccgtgaggggccagaaagtgctctccggaatgggccaaagctgggagggcatcagattgctggcttttgtggctacttccctcaaaagatattatcaggaagcccaactccactttctgaaggc

SEQ ID NO: 5594 - DNA, 251 bp, Zea mays
  misc_feature: Incyte ID No: 700350389H1
  unsure 244: a, t, c, g, or other
cgaatccagaattcctgaatcctgtcactgctcgaaaatcgaaatcgatccgatctccgcttgcgctgaagcctgatctccaccgggttcgcagcaggggcgcaggacctcgatcacgaggaggcaggggagcagcatccacaaccacaagccatggcggggagggccaacatccccactaacaactccgcctcatcgcaatcatcgccgacgaggacacgtcactggcttcttgatggccggnttggcaa

SEQ ID NO: 5595 - DNA, 279 bp, Zea mays
  misc_feature: Incyte ID No: 700350391H1
  unsure 156, 252, 255, 270, 275: a, t, c, g, or other
aggatgccgaagaagtgttgtacactgggaggcctaacagtagcatgggtcaatctttacgagaccttgagaacgaccatgcagatttccagttgacaccacatgatcctcattctgtggttggagaagctaatttgccgcagcataatgtcccancggacagcgatctgagtcctcttggcttactttggtctgagctggaagggcatccaaaacaacctctctcatcaaatgtacttggtgtaaatgaangtngaaacccaaagcctntaacnccaa

SEQ ID NO: 5596 - DNA, 279 bp, Zea mays
  misc_feature: Incyte ID No: 700350392H1
  unsure 2-3, 16, 24, 83, 102, 121, 127, 181, 186, 192, 208, 211, 214, 220, 225,: a, t, c, g, or other
cnnatcctctctggangaacaganaggttaccagcagcaccacggcgagatctccccttggcgggccaaaaccgacggcgagnttcaccggcgttggtcggntccaatctcttcgccgttntatttncctcccaggttaaggttgcaggcttttagcttgggattctgaaaatggggactncttcnggcgcnaatttccataagcaantgntcngaaccnagggnatantgccctcnaaggaatggnccaagccccctcagggtgnataactgggctnt

SEQ ID NO: 5597 - DNA, 183 bp, Zea mays
  misc_feature: Incyte ID No: 700350394H1
  unsure 62, 71, 79, 81-82, 88, 90, 92, 96-97, 117, 122-123, 158, 161, 172, 176,: a, t, c, g, or other
tccacacccccaccaaactaccgaagtggaagggggggaaaatccacgcgacgacgacgcgncgatacgangggaaggntnncaggancnanacanntccccacccgggtccaaacnctagnnacctgcccccgtcctgtccccagttcttcgctgcngtntgacccgcatnattngatgnna

SEQ ID NO: 5598 - DNA, 278 bp, Zea mays
  misc_feature: Incyte ID No: 700350395H1
gtttctgcttccctcattcataaactttatggaaataaattgagaccatttcttgagcatgctgagcatcttacggaggatgtggtttctgtatttccggcagctgatgctttggagcaatacataatgtctgtgatggcctccgttacgggagatgatggtttggatagcctatgcagacataaactagttccatatcagattgaaagtaaatctggtacattagttttaccgccggggtaaatgggcacttgagagattgaacttggtaaagggcc

SEQ ID NO: 5599 - DNA, 223 bp, Zea mays
  misc_feature: Incyte ID No: 700350401H1
  unsure 24, 100, 221-222: a, t, c, g, or other
gtctttctgtgagggtgtttcgangcgctgggcggtttgttccttacatcgcattcgttaacaggttcaaaatggcaaattcttcgtgaagaccctgacnggcaagaccatcaccctagaggtggagcccagtgacaccatcgagaacgtgaaggccatatccaggataaagagggcatcccccctgaccagcagaggctcatcttgccggcaagcagctnnt

SEQ ID NO: 5600 - DNA, 306 bp, Zea mays
  misc_feature: Incyte ID No: 700350402H1
  unsure 3, 45: a, t, c, g, or other
ccngcgattcctctcccctcgcctcctcgtctccccctaggggancgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgctctctatcgacagcatcgtgaaggcagcgacgccgtcatggagccggttgttgtggcaa

SEQ ID NO: 5601 - DNA, 298 bp, Zea mays
  misc_feature: Incyte ID No: 700350403H1
  unsure 274, 285, 292, 297: a, t, c, g, or other
agatctcaatcgccagggcattgattcgtaaatatgcccccgttgctattgtgattgggatagtggtgatgctcttctgggtgaagaacaagatatggtgactggtgccatcttgcgatttcacagttatcatgctggaaccagctgagttgtctgtctccctcgtgcaaccatatgtttgatcgtggtcccaaaaagaaaagatggctcgatggtttatcccgcatctgccgattcaagcgactatttagctatcaaaagcaaaaccaggtantagagatagcntgggaangcacnt

SEQ ID NO: 5602 - DNA, 301 bp, Zea mays
  misc_feature: Incyte ID No: 700350404H1
  unsure 13, 244, 295: a, t, c, g, or other
ctagaagcgtganctgcatgtatacaggcaaccaaacaaagacttaaataaagtcaatgcacgcactgatgcaggatgagacagtgcgactaaccaatcagagcgatagtgcacagggttcttcgttcgttcgttcactcgggtgttttgctagcaatgcaatgcaacaactagctagctagttggtggacggctggagatccataatcgtcgatcgatccatcaggcgaggaggagctcggcntcttcacctggagatgctctcgaggacgcccgccggcgacacgtggcccancaccgt

SEQ ID NO: 5603 - DNA, 301 bp, Zea mays
  misc_feature: Incyte ID No: 700350406H1
  unsure 43: a, t, c, g, or other
tgactgagagaagagatgtcccgcctgaagtttatcacaaggnagctccacatgaagtcgtagctcctccaaacacagttcagttgccgacagcagcattggcaaaccatgctacaaatgtggatcaagcagctgcacatgcactgccaccaagacctaagagggtagcaagcagagagaacattcagcccaaaggatccccacccacacaacttcttgttgaactgcaaagggccagattctgaatattccagctgaggatgtttctctccagaaacagtcagatccacaaggtgatgac

SEQ ID NO: 5604 - DNA, 287 bp, Zea mays
  misc_feature: Incyte ID No: 700350407H1
  unsure 51-52: a, t, c, g, or other
cgccgcctaggagcattcacgttggtggcgggcggtggctcggttcctcanntccaccgcacctccaagaatccacctccacgactgagctgacggctcggcggcgccatggcggttcaccggctccaaccttccctctctggcctacagtgctccaccgcccggtcgccagtgctcctccatgggccacggctgacgggtgcacgcaccggcaggagaggtggatttggtggacctagattcgatgtgcagagagcgattggaggtggctgacatcttcaagcatg

SEQ ID NO: 5605 - DNA, 295 bp, Zea mays
  misc_feature: Incyte ID No: 700350409H1
  unsure 158, 160, 169, 185, 291: a, t, c, g, or other
tgataatgaaattatagttaacaacaggaaaagggcagatctatttttggagctccggcacaagaattttgaccctttcccaaagataaaaaagaaggctgaaccaactgctgtaggtgctatagaagaggaggaaaatgaagagtctcctgatactncngcaggagtngatcctagtgactatnagtatctcctactccatgtcaattggtacctgacttggagaagatacaagagctcaatgctgagaaacaaaagttggtggacgatgttgtggaactgatgaacacncgcc

SEQ ID NO: 5606 - DNA, 293 bp, Zea mays
  misc_feature: Incyte ID No: 700350411H1
  unsure 49: a, t, c, g, or other
gcctcgcgccgccgccacagcaacccttgcagccccaatcccccacggngaccatggccggcgcgcaggagtccctctaccctggtgggcacgatgcgcggccataacggcgaggtgacggcgatcgcgaccccgatcgacaactcgcctttcatcgtctcctcctcccgggacaagttccgtgctggtgtgggactgaccaacccggtccactccaccccggaatccggcgtcaccgccgactaacgggtcccttccgccgcctcaccggccattcccattcgtccaggagt

SEQ ID NO: 5607 - DNA, 292 bp, Zea mays
  misc_feature: Incyte ID No: 700350412H1
  unsure 2, 62, 178, 198, 226, 233, 237, 261, 273, 278: a, t, c, g, or other
gnacttgccaatgcgaacaacgagctggctattaggttcaaagagaaagaaatggtggtgtncagaaatggtgaagagtgctgctgaggcacagacaaagatgctccagcttccagaagacggtggacgagaaagaagacgagctagcagctagagtgcaggagaagagagaagcctncaagcaactgagcgacaccntgtttaccacaagaactatagcgtgacnggtgcgnaacntccgcattcagattcgccctcgcntcccgttctgcnttaantctgaagttcatga

SEQ ID NO: 5608 - DNA, 285 bp, Zea mays
  misc_feature: Incyte ID No: 700350413H1
gggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactcttcttggaacgaaggaggcattggctttgcgccttccggttatatggctaggtacagcaccttatgttgttgtatcctactggtatctctagtgaagttggtctgatctacatgcctg

SEQ ID NO: 5609 - DNA, 290 bp, Zea mays
  misc_feature: Incyte ID No: 700350414H1
  unsure 6, 16, 19, 22, 29, 69, 145, 149, 158-159, 162, 170, 191, 243, 262, 265,: a, t, c, g, or other
aaaatntccctcgtcnggngtngctggcngtactccgaaatctaccattctacccccactccctccggngccgctgcagtgccacccttccatcggtccatccccaatccgctatgcaactgctgctcctactgatactcgcttncttnggctccggnngcntgcggggnggccagcgcggcagactcgtnatcaggctgctggcccaagacatgcggggacctcaacgtcacctaccctttntgggtggaggagcccggcnggncncgtgcggacnacgacntttcagt

SEQ ID NO: 5610 - DNA, 226 bp, Zea mays
  misc_feature: Incyte ID No: 700350417H1
  unsure 207: a, t, c, g, or other
agccccttcaggtctagatctgcctgtgacaactgctgctgggtgacccgtgaccagttcttaccccaggatggggaccatacgcagctcagccttgatcttggcctgcttggctcttgcttctgctgcctctgagggagccttcaaggtttcagaccagagagagatgaagccagagcacctcttccagcacctccatgaagtagnctatgcagcacccccttcc

SEQ ID NO: 5611 - DNA, 300 bp, Zea mays
  misc_feature: Incyte ID No: 700350418H1
  unsure 104: a, t, c, g, or other
gtgctgtcatccaaggtgtacgacgtggcaatcgagtcaccgctgcagctcgcctccaagctctcccaccgcctcggggtcaacctctggatcaagcgcgaggncctgcagccggtgttctcattcaaattgcggggagcatacaacatgatggcaaagctctcccgtgagcagttagagaggggcgtcatctgctcctctgctggaaaccatgcccagggcgttgctctttctgctcagagactgggttgtgatgctgtcatcgtcagcccgtgaacgacaccagaaatcagtggaatc

SEQ ID NO: 5612 - DNA, 292 bp, Zea mays
  misc_feature: Incyte ID No: 700350420H1
  unsure 44, 69, 207, 264, 288: a, t, c, g, or other
gtccaagtatacccagagaaggggacagttgccttttctgctgntctgcatggatgggcctttacactncactaactttgcgaagatgtatgcatctaagtttggagttgatgaatctaagatgatggagaggctatggggtgagaatttcttgaccctgccacaaagaaatggaccaccaagaacacaggttctcctacctgcaanagaggatttgttcagttctgctacgagccattcaagcaattctcaaaaccggcagangaccaaaaggagaattgtggcccngttg

SEQ ID NO: 5613 - DNA, 292 bp, Zea mays
  misc_feature: Incyte ID No: 700350421H1
  unsure 65, 90: a, t, c, g, or other
ctattcttacctatttgtggcgtattcatggtgttgattactatggcacatcagagtcgcatgangccaagggccttcgtcacgtgagantagacagtaagacttctagcacatctgatgtcagttctgctgattgggagaagaagctggatactttctggcaggaaagactgaatggtcaggaccagctggtcatacttactgccaaggacaaaattgatgcagcagctgctgaagttttagaacctctgttcaggaaaatcaggatgaaaatatggatggaaatatggct

SEQ ID NO: 5614 - DNA, 287 bp, Zea mays
  misc_feature: Incyte ID No: 700350422H1
  unsure 218, 253, 264: a, t, c, g, or other
tctccagttgcacccagacaagaacaagtcggttggtgcagaggttgccttcagacttatctcggaggcatggagtgtattgtctgacaagagtagaaagatgctttatgatcagaagaggagagaccattgtgtggcgagtgtgtccaacggtttgtatgctatgattatgatacaaagctcagtaagcgagcacgaaaaaatgccgttgcctctgncctcagcagctgttgaggctactactcgtcttgcngggctgacacntcggacatcaggcaacagcgcag

SEQ ID NO: 5615 - DNA, 293 bp, Zea mays
  misc_feature: Incyte ID No: 700350426H1
  unsure 11, 38, 99, 137, 189-190: a, t, c, g, or other
gtgagcgagcngcagtaggcagcggcgcggggcgaggngcagaccagcacccagcagccctcgtcggggggcggcagtgcagcttcaccagccgccgcntttccccgtctccctctgcctctgcctctccccctaanccccttccatttctccaccccaccccgctcccgcttccgcttcctcgccacnngttcgttccgcacccgcagccgcggctgcgtttcgcattgggggcagcaatggagcagtacgagaaggtggagaagatcggggagggcacgtacggggtggtg

SEQ ID NO: 5616 - DNA, 290 bp, Zea mays
  misc_feature: Incyte ID No: 700350427H1
  unsure 7, 43, 45, 81, 86, 289: a, t, c, g, or other
tcgcgcncgcggcggccggcggcgagccctcacccatccgagnantgccgaggaggaagcgagcgcgcgaaagtatcaggnggagncatgggtaccctggggcgcgcgatcttcacggtgggcaagtggatccggggcacggggcaggccatggaccgcctcggatccaccatccagggcggcctccgcgttcgaggaacaggtttcaaggcatcgtacaatcatgaatatttttgagaaagagccaaggatccatagagatgtgtttgttgctcccatgcagcattcnt

SEQ ID NO: 5617 - DNA, 286 bp, Zea mays
  misc_feature: Incyte ID No: 700350428H1
  unsure 34, 191, 195, 197-198, 200: a, t, c, g, or other
acctctgcctgggccctacggctccgtctcgatntcgacaagtttatcacaatgccacgccggatgccaagtctctcaaatctggaatcctttcacgccgccactctcccctttttccttctctcttcgtcgttgtggctcctgccttcctgcctcggcgcatcgactcgcggagagggacagcacagcgntttntnncnctcctttctccattcccagatcgaaggtccataaaaaaccatcttttgcatctgattgagcatgtctttgtgcaagagaacattta

SEQ ID NO: 5618 - DNA, 281 bp, Zea mays
  misc_feature: Incyte ID No: 700350430H1
  unsure 27: a, t, c, g, or other
cccgtcgcatcccatcccactaccacncatctcgtcgtccgccgattcgatccagttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccactgggtctccaaa

SEQ ID NO: 5619 - DNA, 297 bp, Zea mays
  misc_feature: Incyte ID No: 700350432H1
  unsure 21, 72, 78, 117, 158-159: a, t, c, g, or other
ttcagattcttttcgcaagcngtcaagttcaggtccgctgatgacaggcaagaacaggaagttctggcagangttgcnaagcctgtcaagagggagcatgagtgagcatggcatctncaccagactatgaaacccgctcgcaatatagtggtaggtgnngaaacctttgcttggcttgattagaaaacggattgatactcagactgggaataaaagagttcaagctgagctagtgtaaactacggcatctggaggtgaaagctatagcttcaggatctcattcagagtagcagagtg

SEQ ID NO: 5620 - DNA, 293 bp, Zea mays
  misc_feature: Incyte ID No: 700350433H1
  unsure 2, 126: a, t, c, g, or other
gngacggctgcggcgtggacaagcccgagcacgacccgtgatcggcattggatcctgcgcatgtggagccgagcgcggggccattgcggacatccaatcgaatccaagccaagcgtgactgcttantgcgaaaataaccgcatccttttcttcttcttctccccatgtccctgtctgtcaatcctattcttgggcgtgccaggatttgttcacctggccatgccgtattccatgtcaccggaccggctatagtatatagtactagattccattccattcctcgtgcccacgca

SEQ ID NO: 5621 - DNA, 243 bp, Zea mays
  misc_feature: Incyte ID No: 700350434H1
ttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcggtagttttccgttggctctggctgcctcctctgcttctgagattccaacttgtctgcccatctctcctttc

SEQ ID NO: 5622 - DNA, 282 bp, Zea mays
  misc_feature: Incyte ID No: 700350435H1
  unsure 265, 269, 272: a, t, c, g, or other
ctgtttgaggagagtgtttgcctccttctgagggcagcttggtttgaacctctgatcgtagaggctcacgaggaggctctggaagaagaagagtttctccaccagcagtaccaatacgatgatgacgaagatgatctgacgaggaatcttattacatgaacaggtccccaagcatcctattggtaacaggagatggggtgacatgggtacatcagggaggcaggaaagaggcgaggccatgaatactgatgtggctgctggtccntccngantccgagaaga

SEQ ID NO: 5623 - DNA, 284 bp, Zea mays
  misc_feature: Incyte ID No: 700350437H1
  unsure 179, 192, 259: a, t, c, g, or other
gtggtgttatctaacaaggaaaaatattctccaaatgagaatgctgaagagagtggtagttctaacgttgaagcaccacgccgagacaatattgagtcaacatctacttcatcactctcagctgacgaaccagttgtagttgggacagaggaaattgcaagggttgcctcattatggtncgggataccagtnacagcagttgactgctgacgataagaaactctagtaggactggacgacgaactcagaaaacgtgtcntggccagatgatgctgttgtggcca

SEQ ID NO: 5624 - DNA, 279 bp, Zea mays
  misc_feature: Incyte ID No: 700350438H1
  unsure 248: a, t, c, g, or other
tgaactaaaggaagaagttcaagaagcaccaagagtgaaaatgttgcattgcccaagcaaggcaatggacattgagaacgagatccaagttctgtgtgatcaactggctaaaaaatctcagattctcttcgcctttgaaagagttggagctgcatcgaagttacggggaaaatgacatgccctgtatgaactaaagggtctagaaacttaggctcaacgttgcacatagttgttcacgactgtgcctngtagattcggaacagttccattccgtggttt

SEQ ID NO: 5625 - DNA, 285 bp, Zea mays
  misc_feature: Incyte ID No: 700350439H1
  unsure 85, 260: a, t, c, g, or other
cgcacaccatctcatcctttctcatgcagctgcggtcaggcgataccgcgacaagtatcagcttcaccagaaggggaagattggnattctcctggattttgtgtggtacgaacctttcagcgacagcaatgcggaccaggctgcagcacagcgagccagggacttccacctaggctggttccttgaccccattgtacatggacggtacccgtactcgatgcaagagattgccaaagacaggctaccgttgttcagcgatnaagaagccaggatggtgaaaggctc

SEQ ID NO: 5626 - DNA, 283 bp, Zea mays
  misc_feature: Incyte ID No: 700350440H1
gttgattcagacgtcctccgctgccagtctgcgttgtcataccgtggagtttgttcgtccaggatattgccttcggaggacgatagtcttgcaagggctcttcgctcgtgccactcgcagcctttctcattcgtagaggaaggagacaccggtgcatcagggatgataagcttagcagagtatctaggaactaatgtagctgaccacatccctgaaactcccaacaacctgttcagaggagatggtgagatgcaggcggggatatactgcagacttgcagatc

SEQ ID NO: 5627 - DNA, 284 bp, Zea mays
  misc_feature: Incyte ID No: 700350441H1
  unsure 57, 153, 182-183: a, t, c, g, or other
gcagcagcgagtccgtacgagggttatatacctgcacaccccaaggcatttggaagnacgaagaggatggagagaaaatgccccggtgtctgccagtatgtgggaagcctgtacaaccccgtgacacagaagcagcgcatgcatcggagggcngaaagccaatccgggcaacttcccctggnnagcattcaccaatatccacgggcgagggggcgggccctgcttggagaccgctggatcctcacggcagcccacaccatctaccccaaggaacacaacaaaga

SEQ ID NO: 5628 - DNA, 281 bp, Zea mays
  misc_feature: Incyte ID No: 700350442H1
  unsure 2, 48: a, t, c, g, or other
gntacaccaccacacccacaccccatcccagcacacaacaagcagccnggtttacggtagctgctagcaaaacaatggagaaccctgctccgagcatcgtagtggccatcgccgcacccgtggcggcggagttcgtgaaactcaccttccgtgccctgtatatgcgccgggctggtcctggcagcagggagatgactgtgccgggaaggccatccgaccagctgggcaggagagtcgttcatgacagccccgtgtacgacggccgtggcgccgacgcccgc

SEQ ID NO: 5629 - DNA, 283 bp, Zea mays
  misc_feature: Incyte ID No: 700350443H1
  unsure 159, 170: a, t, c, g, or other
aagcaatcacgagacgggaggggttggcctttcgcctctagggttccgggtcgcccaccaccttaccggaaatggcaattgcgggacgcgcccccaatcactcaccacccctttcgtctcgccctttttaacccaatcccctctccacgattccacacncatctcctganctcctgctgcctgcgctcgcctcagctcctttcttccccgccccttggcttttgcttggttgcatcgggccggtcgagccggagaggaaaagctagctagcagctaccagctc

SEQ ID NO: 5630 - DNA, 285 bp, Zea mays
  misc_feature: Incyte ID No: 700350444H1
  unsure 2, 32, 165: a, t, c, g, or other
tnctgataaggtcactatagatgtcgcaagtnctgaggctggtgttattgaaaagctcattgctagtgaaggcgacacagttactccaggcactaaagttgcaatcatatccaagtctgctcaacctgctgaaacacatgttgctccatcagaggaagcaacttncaaaagaatcatctccaccaaaagttgaagataaaccaaaggtagaggaaaaagccccaaaagtagatcctcccaagatggcaagcaccaaagccaatgcaccatcaaaaacatcccctt

SEQ ID NO: 5631 - DNA, 282 bp, Zea mays
  misc_feature: Incyte ID No: 700350445H1
gggaggcccagctgggatcatgaagtgcaagtatgtagaactcacttcagactttgtgtatccctacagaaatccagggtggatttgatatgatctgcagtggaagggacaagattgaaacaccggagcagtttaagcaagctgaagacacggccaacaagcttgatttggatggacttgttgtcattggtggtgatgattcaaacaccaatgccgcctcctggtgaatactttaggtcaaggaacatgaaaacccgtgttattggttgcccaaagactatc

SEQ ID NO: 5632 - DNA, 282 bp, Zea mays
  misc_feature: Incyte ID No: 700350446H1
  unsure 243: a, t, c, g, or other
gttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtncacttctccaggaggaggcgatgcggaacgccatcgagg

SEQ ID NO: 5633 - DNA, 288 bp, Zea mays
  misc_feature: Incyte ID No: 700350448H1
cgtgatgatcggcgacggtaagtcccgcttcaccatcagcgggcagcccatcttccacttcgtccgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggcttgctgctatggaaggtgctagactggctggtgc

SEQ ID NO: 5634 - DNA, 135 bp, Zea mays
  misc_feature: Incyte ID No: 700350449H1
  unsure 32, 81-83: a, t, c, g, or other
ctccttttgtcctctttagaagccaccatggngctcagtgatggggagtggcagatggtgctgaacatctgggggaaagtnnnagggcgaccttgctggccatggacaggaagtcctcatcagtctatttaaggc

SEQ ID NO: 5635 - DNA, 299 bp, Zea mays
  misc_feature: Incyte ID No: 700350453H1
  unsure 2, 286: a, t, c, g, or other
gngtcgcaagggcaggacggtgccgccgtggaggaagaggacagcggtggcggcgactacgacactgtgctgaaggcccacgctagatccggtggcggcgactacggcgccgtgctgaaggcccgcgctagatccggtgccagcgacgggttgctgcatgactgtcttctcatgtatgaggtggtggaggcgccatgtgtgaagaaatacaagaatgtttatgtggtgagcaccatctcagagttctcatcctcgctggagacacgggtgggcatggcgggtggangtcttctccgtgc

SEQ ID NO: 5636 - DNA, 298 bp, Zea mays
  misc_feature: Incyte ID No: 700350454H1
  unsure 290: a, t, c, g, or other
gctgaatgaaagagaccactcacgctgctgctgtgtcaggttcagcgacgagacttttgctccagctgccggggaccatccaaaaccagccattatagatcaaatcaagtagagttcaagtgctaggaaataattcattgcatggtgtatcttgccgtgatccatcccttcgctgagcacatggttcactacgtcctgttcgccatccccatgctgtcgactctctacatggggaacgcctccgtcctgggcatcgtgctctacatcgcctacatcgattcagaacaacnggggcatg

SEQ ID NO: 5637 - DNA, 292 bp, Zea mays
  misc_feature: Incyte ID No: 700350456H1
  unsure 69, 111-162, 228, 239, 249, 258, 281, 286: a, t, c, g, or other
tcaacaccgagacgccaggttgacggcgcagactgcggaggagctcgccacccagatcgagcagcagangctcgaggagcagaagaccgaggcagaggaggttgtggtggnnnnnnnnnnnnnnnnnnnnnnnnnnnnnnnnnnnnnnnnnnnnnnnnnnnncggacaagaaggggatgccagcggcaagttcaaagcaaagcaggattgagaagaagagccgcaaanccatgctgaanttggcatgangcccatcanggtgtcagccgtgtcatgtaaanaaaanatattt

SEQ ID NO: 5638 - DNA, 296 bp, Zea mays
  misc_feature: Incyte ID No: 700350457H1
  unsure 14, 27, 73, 96, 128-132, 163-164, 170, 230, 248, 270, 281, 289: a, t, c, g, or other
ggtctgtgcctggnccagccagctgtnttgttcctccgtccgggaggacgatggaggaggaggcgcatccctnccatcctactgcgactgcgtgcntctctcgagctcgagtcgattgatgattcatnnnnntagtctcgtctccgcgccattctccaaatcnntctatngtcaccatcccgatcccagccccagacccgatgcagcaacagcaggacccagcacccgcngatcccgacccatgccgncccccgacctcggtgatgccgngcctcgtccgnaaggagangatcctt

SEQ ID NO: 5639 - DNA, 285 bp, Zea mays
  misc_feature: Incyte ID No: 700350458H1
  unsure 39: a, t, c, g, or other
ctggggcgatgatggatacttcaagatcataaggggcanaaatgaatgtggcatcgaggagggcgttgttgctggaatgccatccacaaagaatatggttccaaacttcggcggtgccttggaagagctatagtttaatggttacgtttgcatggcctcaaatgctgttggaattagctaaagtaattttaaaatgcaatgttaaagggccacgatggtgtatgtatttgtacactagctcattcaaaggtcgttagttgcggtgccacatcatttggtcagtgg

SEQ ID NO: 5640 - DNA, 291 bp, Zea mays
  misc_feature: Incyte ID No: 700350459H1
  unsure 4, 7, 9, 27, 32, 51, 79, 98-99, 124, 273, 289: a, t, c, g, or other
cagnatntncaacctcaggctcaaggngactntggcgagcctccggaagangcaccctgatgccgcgttcacctacgtncgacgtctacaccgccaannttaagctcatcagccaggccaagangctcggcttcgacgaccctctgctgacctgctgcgggtacggcggcggccggtacaacttagacctgagcgtcggctgcggcgggaagaagcaggtgaagggactcggtggtggtggggaatcgtgcgagaacccctccaagagggtgngtgggacggcgtgcantc

SEQ ID NO: 5641 - DNA, 290 bp, Zea mays
  misc_feature: Incyte ID No: 700350460H1
tgctctttaatgtttgtgacaagccatagaaccaagggacataaggattcaggctacattggacttgttcacgagaaaggggtactttcttcagacaagaatgcaatccctcatttttgcctgcaaaacttctgcagaagttattgaatctatccactacaagtgaaagatatctcatagacgcagcatggttgttgattgaaatggtcaacgatagtaatacgaaggagaaattgaggaaactccgtgttgtctcgggaaggatggctaaatctctccctcccagattc

SEQ ID NO: 5642 - DNA, 290 bp, Zea mays
  misc_feature: Incyte ID No: 700350461H1
  unsure 2, 108, 256, 269, 280: a, t, c, g, or other
gngtctcgcgcgaagaatccgcatttccccttccccgcaccgcaccgcaccgcacccaacccccgtacggagagagagatggcatcggtggcggagatgcagcccctngcgccggcggggtaccgcgcgcgccggagatgaaggagaaggtggaggcgtcggtggtggacctggaggccgggaccgggagacgtgtacccgggatctcgcgcggggagagcgccctccgatggggttcgtccgcaagtctacggcntcttcgctgcgcntgcacttcacnacgcgtctcc

SEQ ID NO: 5643 - DNA, 209 bp, Zea mays
  misc_feature: Incyte ID No: 700350462H1
gggaaaataagactaaagaaattgttagattaaatggtgtgtatcagaggatccttaccagtgccggtgtgacaatgattgaaggggcaggcagtctagttgatgctcatactgttgaagttagccagcctgatggttcaaagcaaaggtatacagcgaacacattttgatcgcgacggtagccgtgctcaacgtgtcaacataccgga

SEQ ID NO: 5644 - DNA, 302 bp, Zea mays
  misc_feature: Incyte ID No: 700350464H1
tgttgattgccaatgggagggaatgtcctgagaagacagttctgaaggatgggctctcattggagattagaagagctctagattcttgcgtttgtaacgccgtgccagtactcatatcaaacttgaggttgcagataccggtttcaaaactggagattactctgggctacttgattgacacaatgtcgtttgttgacgccctgcctctctgcgatcgaggcatggcaggctgtggttctggtaatgcttgacgcgctctctgttcaccagcttcccgccctgctccatctttcgattcgagc

SEQ ID NO: 5645 - DNA, 300 bp, Zea mays
  misc_feature: Incyte ID No: 700350465H1
  unsure 2, 24, 66, 149, 151, 154-155, 205, 248, 270, 281, 283, 287, 294-295: a, t, c, g, or other
cntaacctgtcccgggtgcatcantgctctcggctagcccggtctacctactcttcaccgctcgcncgccggcccactccccaccgcagccatggacgccatcaagaagaagatgcagatgctgaaactggacaaggagaatgccatcnancgnncagagcaggccgattccgacaagatgcaagctgaagaccgatgcaagcantggaggaagagcagcagccctccagaagaactgaggggacagngtgaggtggaaaattttccganttgtgaagatncnaganaatggannagcca

SEQ ID NO: 5646 - DNA, 300 bp, Zea mays
  misc_feature: Incyte ID No: 700350467H1
  unsure 2, 37, 41, 227, 279: a, t, c, g, or other
cnggattgatactatgattcttaatctgatgagcganactncgaagtcatatgacatttctcaaccacttacaggaaattaatgagtctgtcagacttgcatttttgaattcctttctggattttgctggttatctggagaggtttggaggtgaactaactgagaacaggccaaacaatgaaaacaattatgttcaaaatggatacataaatggtactagagaaacntctgctaacacagatggagattgcacaaaaagctgcggttgtttgagtaacntggatattgtaaagctgaact

SEQ ID NO: 5647 - DNA, 252 bp, Zea mays
  misc_feature: Incyte ID No: 700350469H1
aaggcaggaatcccggcctttgcttgcgcgccactccgggcaccggctgcagctcgcagaaatggttagccagtagtatgtatgtgcattctgtatatatacaagagagcaatcatttctttggaaaatggcacttccactctgattgttaaatagggtgcctaccctgtggaaaggggttgaactgtatctgtaatctgacatccacatctccagctgaacaaatggcctccatggtatggaatctcaatc

SEQ ID NO: 5648 - DNA, 287 bp, Zea mays
  misc_feature: Incyte ID No: 700350471H1
  unsure 21, 87, 140, 160, 232, 252, 257, 273, 283: a, t, c, g, or other
tcagccgcgtcgcaccgcatncgcattctacgattcgaagctctctctgctccgcagccatggcgaagaattacccaaccgtgagcnccgagtacagcgaggccgtcgagaaggccaggcgcaagctccgcgccctcatngccgagaagagctgcgcgcncctcatgctccgcctcgcgtggcactccgcggggacttcgacgtgtctcgaggacggcggtcccttcggtantatgaagtgcccggcggaanggctnaggcgccaagcggggnggaaatcgcntggg

SEQ ID NO: 5649 - DNA, 287 bp, Zea mays
  misc_feature: Incyte ID No: 700350472H1
  unsure 113, 263, 280: a, t, c, g, or other
cagcttttccatcacaggattatccggtgcggtggtcctgttgaggatgatatggccaacatcattgtagcacagctgctctacctggacgctattgatcccactaaggatancattatgtatgtgaattcaccaggagggtcagtgacagctggaatggctatatttgatacaatgaagcacatcaggcctgatgtatccactgtttgtatcggactagctgctagtatgggagctttctacttagtgctgggaccaagganagcgatacagctaccanactcgag

SEQ ID NO: 5650 - DNA, 282 bp, Zea mays
  misc_feature: Incyte ID No: 700350473H1
  unsure 2, 16, 149, 151, 241, 250, 274, 276: a, t, c, g, or other
gncgcgctgtcctctnctctgcaccgactctgtcctgcggaaccatggccagcccgctgcgctccttgatgctactgctggccgtcctggccgtggcctgggccggaacctccaggccacccccgcgattgttgggagctccgcaggangnagatgccagcgaggagggcgtgcagcgagcgttggacttcgccgtaagcgagtacaacaagggcagcaacgatgcgtaacacagccgcgncatacagtngtaaaactctaagcacttgtggcngnaaaaat

SEQ ID NO: 5651 - DNA, 296 bp, Zea mays
  misc_feature: Incyte ID No: 700350478H1
  unsure 24, 42, 216-217, 219-220, 222, 254, 285, 292: a, t, c, g, or other
gcaatatacacaatatcacaattncacatatacagattcacnagcttaatacataattcacaaaacacattcacatatacataaatagtccatagtccattcaaataagtctagagtccaaaagtctattgtccattcaaatacacaattcacaaaactctagtccataagtctctgtccataagtccataagctactcactactcactactcacnngnngnggatcactccggcgggctgtgggagttttggncatccctcctcggcaaccaggaaggtggcantccctcnacaa

SEQ ID NO: 5652 - DNA, 295 bp, Zea mays
  misc_feature: Incyte ID No: 700350479H1
  unsure 45-46: a, t, c, g, or other
aaatcctcccacccggtttagccggctccgctgccaccgccgcgnntccacctctgtcgccaccatggtcaagtccaaggccatcagggtccacgagctgggcggccccgaggtgctgcggtgggaggaggtggaggtcggggagcccggtgaaggggagatccgcatcaggaccaccgccgtcgggtcaacttcatcgacatctactttcggaagggggtctacgccgcgcccaccatgccttcacccaggaatggaagccgttgggtcgtcaccgctgttgggctggctcatg

SEQ ID NO: 5653 - DNA, 296 bp, Zea mays
  misc_feature: Incyte ID No: 700350481H1
  unsure 48, 56, 61, 64, 67, 94, 101, 142, 148, 159, 239, 293: a, t, c, g, or other
tgaccccgagtcccgaggccgacgccattcctgattcctccatcttcngttccgcngcacngcngcnggagatatgtcgaggctcgctgctgcngccctcngctgcgtcgtcactgcatcgagagatacctcctcatctcgnttcgcngtgtctgcgcnggtgtctgctcggctcttctccgcggatgcatccggtgaagccgccgccaggccgcagagtcgcaggatgactctttctnaaggcatcccgcgaagattagctatggaagtttacatgtcatggtggaggcatngtc

SEQ ID NO: 5654 - DNA, 290 bp, Zea mays
  misc_feature: Incyte ID No: 700350482H1
  unsure 167, 248, 273: a, t, c, g, or other
gtctcggaagtctggttcgccgaacagtcccgaacccccgattcactgccgctgccccgtctcgtcctcttcgccagcgaaaaccctagtctaggggacgggagcgcaatccacgcacggcaacatggacgccatccgcaagcagctcgaccagcttcatgggggcnaaccgcaacggcgatgtacgggaggtcagccgcaagtatatgatcgcgagtctgccgctctacctcgcggctctgccccangacctttccagttaccagtggactnggccctgccgaactgca

SEQ ID NO: 5655 - DNA, 293 bp, Zea mays
  misc_feature: Incyte ID No: 700350483H1
  unsure 283: a, t, c, g, or other
tccctgaaaacctcacaaaaccctcgtttgctccccaccaccccgccgcgccgccgcctgtaccagctgcgtcaagatgagtcggcaccctgaggtgaagtgggctcagaggatcgacaaggtttacatcactgtactgttacctgacgcaaaggatgctaaggtcaatttggatccagatggtgtcttcacattctctggcagcgctggtacaaacttgtatgaatgaaacttagtctgaatgacaaataaacgttgaggctagcaaaataatgtgggggtnagtccatatc

SEQ ID NO: 5656 - DNA, 276 bp, Zea mays
  misc_feature: Incyte ID No: 700350484H1
  unsure 262: a, t, c, g, or other
tgttttcttctgtttttcggattgaactttaaaatcctagcattttggccaaaatcctggatgtacccattgagtgctaatttcaggtatctggtgccttcctgtaaaactgttgtttcagttcctaattttcaaatttgttgcgctggtattaactctgcttgtacccatgaagttatttattaatgcttgttggactgcatttcaaataagttcctgaaaccgtgtttatggtagtcggttctccatctatgaggctagntgaggacaaacagt

SEQ ID NO: 5657 - DNA, 283 bp, Zea mays
  misc_feature: Incyte ID No: 700350486H1
  unsure 19, 35, 42, 46, 57, 74, 80-81, 96, 118, 131, 144, 184, 224, 232, 241, 246,: a, t, c, g, or other
tcgagcggatgaatggtcnacttattgatgcaaantctgganaganagttcattccntaaaaggacatcgggantactcnnttgcatcggcttggngccctgatgggcgaacatttgntaccggcaaccangacaagacatgcngaatctgggacgtgaggtacctttcaaaatccgtccatgngttgaggggtaaccttggagccatccggtccatccgcttnacctcggntggccagtncatgnccaggctgaactnngattngtgcacnctacangtgaa

SEQ ID NO: 5658 - DNA, 275 bp, Zea mays
  misc_feature: Incyte ID No: 700350490H1
  unsure 2, 250, 271: a, t, c, g, or other
gnagcaagctgctaatggcatcccgacatctccattacctcgtattcgggatgaagcaacaaatacatgcataaatattgcttcaatcttaccgcaaacactgtgcatctgtaacttcatcagggcagttgattctcccagaggctctaaaactgctgcccttatatactttggcactggtcaaaagctaggcttgagaaccgagggcgattggatgacgttcctatggatatcgtagcctcgtcaattncgtagtacagcgttccttggngtcc

SEQ ID NO: 5659 - DNA, 275 bp, Zea mays
  misc_feature: Incyte ID No: 700350491H1
  unsure 46, 213: a, t, c, g, or other
gcggcggaggaaacagtcagcccggatacggtggaggatacaagcnccatcaccctggtggcggctacgggtctggacaaggagggcctggatgtggatgtggaggagggtatggaggtggcaatggtagtcctgggtacggcgatgacaatggtggtggcagtggcactggtggcggaaatggcaatgctggtgggtacggaggaggaggangcggcgttatggaagcgctacggcatggtaatgtacagcacaagaggcggatatctggcgtg

SEQ ID NO: 5660 - DNA, 288 bp, Zea mays
  misc_feature: Incyte ID No: 700350492H1
  unsure 280: a, t, c, g, or other
ccaactgttagaatggacgacacggaagccgccaagaacacggccaccaccggccccactttcgcctcccctctcttctctttactccaacctcggcggtgcttccttcggctctggctttggcttcaaatccagcgctcctctgccgcctgccatcgaggtccagctctgcgaggaatcacccgttccggcagctaggttggagccagtcgtggtcgatgactccttgacgatctacaagggcagagtgagtacatctgacgtgtttggtgtcaaagantctgattg

SEQ ID NO: 5661 - DNA, 85 bp, Zea mays
  misc_feature: Incyte ID No: 700350493H1
  unsure 44, 46, 51, 65, 78-79, 82: a, t, c, g, or other
cttttcacccccaacgaaaaaagaatctaacttattccgtcgtntnctttnttttttcttttttngataccatatagnngcnagg

SEQ ID NO: 5662 - DNA, 286 bp, Zea mays
  misc_feature: Incyte ID No: 700350494H1
tgcttggcagcgctacaggagctttctggaaaccttagcctgatgaaggttaggcattctgctaaggggaaagtgctcatgcgagcattgtatggaatcgaggctgttaccgtcttaatctgcagcgtacttgtagctgtactgtcgggtaccttcaagccactggtggacttgatgtccctgagaaatttggttggtctacggcctcatgatctcagaaggccataagcggtgaacttagcagcaatgtccagaggtatgttgcagctgtaaaagagctggagga

SEQ ID NO: 5663 - DNA, 289 bp, Zea mays
  misc_feature: Incyte ID No: 700350495H1
ggctgaatgactcaaacagctggtttgatggctgtggcagagtacttttatactgtgtccagcacaactatcctgatgtctgcaattgatctacttaagcagatcaaggagaaagatgaaatgagtacatatatggttgttgatcaggttttttgccaaatatgggacatggagaccacaaatttggattttggaatggtgtttctgatgctgtcaaagagctggactaatgtttctcggacagcctgacttctctcagcgcatgtgtaaaagcaaggattgcgacgtg

SEQ ID NO: 5664 - DNA, 300 bp, Zea mays
  misc_feature: Incyte ID No: 700350496H1
  unsure 2, 37, 112, 128: a, t, c, g, or other
ancacaactcgtaggcagcgagcgtctctcctcttcntctcccacgcaccgcgccaaggaaggcagagagagatcgccgctcctcttctctccgtcggtggtgcggttgacngccctcctcgagcganatctcgctgcagtccctcgagatctggtcacagatctatccgacaagatggtgaagatctgctgcatcggtgctggctatgtcggtggcccaaccatggcggtcatgccctcaagtgcccagacattgaggttgtcgttgttgacatctccaagccccgcttgaggatggaa

SEQ ID NO: 5665 - DNA, 199 bp, Zea mays
  misc_feature: Incyte ID No: 700350502H1
  unsure 191, 193: a, t, c, g, or other
attccttccattttacccctccgtccgtccgtctctcacactgtctctttccaccctctcgctctccgacgaggcgacgacgggtaggccatcgccgccggcgccgtcccactacgacaagtgctgaggccttcatcgctttcttcgccggcgacgagcacccaccaactaaggtcatggaagagatgatntntctaac

SEQ ID NO: 5666 - DNA, 187 bp, Zea mays
  misc_feature: Incyte ID No: 700350503H1
ctgccttgccctcagaggatctaagacatggcacctaagaaagccaagagaagggcagcagcagaagggagctccaatgttttctccatgtttgaccagactcagatccaggagttcaaggaggctttcactgtaattgatcagaacagggatggcattattgacaaggaggatcttcgggacacct

SEQ ID NO: 5667 - DNA, 188 bp, Zea mays
  misc_feature: Incyte ID No: 700350505H1
  unsure 17, 21, 30, 36, 38, 43, 61, 126, 170: a, t, c, g, or other
cgacgcttctgcggttntgcngccgccgtncgcgcngnccacnccctcgatcgcgtccctncgctgctttgccctctccaccctaccgccatcaccgccgcggcgtccttctgtaccggatccgtngcagccaccactccgaagatccgctgggttgacgtccagggagntgctccggggatgtcgtc

SEQ ID NO: 5668 - DNA, 137 bp, Zea mays
  misc_feature: Incyte ID No: 700350507H1
  unsure 25, 32, 88, 120, 134: a, t, c, g, or other
ggtgctgtgagaggtatcggtaggngctacgntgactccggggtgtgaagccgaccggtctgacttttcatcactgccgaacccactngaaccacagccatgtccggggacgagatgatntttgatcctactangag

SEQ ID NO: 5669 - DNA, 101 bp, Zea mays
  misc_feature: Incyte ID No: 700350508H1
  unsure 12, 14-15, 20, 33, 48, 58, 70: a, t, c, g, or other
atgcagcttcangnnagcgntgcagcaatggcncgtcaatatgttcgnagtgtacatntctgctgtgcanagagtgttcgatggctatattctccctaccc

SEQ ID NO: 5670 - DNA, 179 bp, Zea mays
  misc_feature: Incyte ID No: 700350509H1
  unsure 21, 25, 33, 161: a, t, c, g, or other
ctcgcttgcactccgctcgtntganatctcgtnccgtcctttcgtttcacaagcctcgcgagccccgacgatggccaccaccgcggtgtcggtccgacgagaagctcgataagcttcgcgccgaggtcgccaagctcgaccagatcagcgagaacgagaantccggttcataagcctct

SEQ ID NO: 5671 - DNA, 123 bp, Zea mays
  misc_feature: Incyte ID No: 700350510H1
  unsure 36, 44, 97, 115: a, t, c, g, or other
cttacattttcttgctgatcacagctagtagggacncgagagtnaccttgaaattcaaggcagtacgtacgagtacgatcgaccaatgtcgacggtncacttcttggcacctttnctgagcct

SEQ ID NO: 5672 - DNA, 166 bp, Zea mays
  misc_feature: Incyte ID No: 700350512H1
  unsure 15, 18, 27, 52, 54, 73, 78, 133, 138, 159: a, t, c, g, or other
gggaaaactggaggnagntattcttanaacaagcatccttattgttgccttnanccacaacattgacaaagcnacatncgaagatgaagccgtatgagtatggattccgtgtgttcttgttgagcattctgtnacgtnatggtctctgggtacaacacngggaaat

SEQ ID NO: 5673 - DNA, 139 bp, Zea mays
  misc_feature: Incyte ID No: 700350513H1
  unsure 67, 113: a, t, c, g, or other
aaccttctagggcttcttccccatacatttacccctaccactcagctatctataaacctaagcatanccatccccctatgagcaggagccgtaattgtaggcttccgacacanactaaaaaattctttagcccattctt

SEQ ID NO: 5674 - DNA, 140 bp, Zea mays
  misc_feature: Incyte ID No: 700350514H1
  unsure 86, 91: a, t, c, g, or other
cgggttcgtgaggttctccggggttcggtttcgtgggtgggcggatcgagatggcggcgtcggatgttgagtaccgctgcttcgtncggcngcctcgcctgggccacggacgaccactccctccacaacgcttccagcac

SEQ ID NO: 5675 - DNA, 188 bp, Zea mays
  misc_feature: Incyte ID No: 700350515H1
  unsure 20, 54, 57, 63, 85, 127, 143, 152, 160, 168, 187: a, t, c, g, or other
gaagaagaatccttctcgangccgcccccattcattcttggagggcaagaagancgngcagtnccaaaagcgaaacaaggggaangggcgaggcagccaaacgaatcccagcactgcctctcctttncttgcgcagatctagngatggcggngggcggtnagttggcntggggggagaagccgtggnc

SEQ ID NO: 5676 - DNA, 184 bp, Zea mays
  misc_feature: Incyte ID No: 700350517H1
cacaaacaagagcttaaactgtcacagtacaaggatatcgagaagcgatatactaatcaatttctccagcttaagacaactgaaatggcaaacaaggacttggacagatattatactgctttagacaaggctcttatgcggttccacagcatgaagatggaggagataaataaaataatcagga

SEQ ID NO: 5677 - DNA, 186 bp, Zea mays
  misc_feature: Incyte ID No: 700350518H1
  unsure 102: a, t, c, g, or other
cgtgactccgccgcaaagagagggagtccacggtctgaagaagcaacggcgacgcccccgacgacgagcatagctgccccgcaaactagcagcgccctcgtncagttccgtctcgttcccaacctctcccggattcgattcgattgacccgtccgctcccaaatcgaatctaattcagcattttgg

SEQ ID NO: 5678 - DNA, 182 bp, Zea mays
  misc_feature: Incyte ID No: 700350519H1
gggcccttgatgctggtctggaacacgccctcctgggttctgtagtgactgtagacaggtatgcagctgccgagggtttctataaactagctatggcctatgcacccgttccagatcttcacattatgtggttgcttcatctgtgtgatgcacaccaggagatgcaatcatgggctgaagca

SEQ ID NO: 5679 - DNA, 194 bp, Zea mays
  misc_feature: Incyte ID No: 700350522H1
  unsure 152, 182: a, t, c, g, or other
cgcctccgacatcctactttcgtcctcacgagtgaccgataatccgccggcgctaagatgttggtttatcaagatctcctatctggcgacgagctcctgtcggattcattcacctacaaggagctcgagaacggcgtcctgtgggaggtcgncggaaagtgggtcacccaaggtcctgttgncgtagacattgg

SEQ ID NO: 5680 - DNA, 82 bp, Zea mays
  misc_feature: Incyte ID No: 700350524H1
ctgggagaagaggaagaagaggggaggcgcgacaaaaagggcgccgcgccacgcatcgcccccgacgccggcatctctccct

SEQ ID NO: 5681 - DNA, 182 bp, Zea mays
  misc_feature: Incyte ID No: 700350525H1
  unsure 2, 30, 32, 39, 64, 73-74, 82, 87, 107, 134: a, t, c, g, or other
gngtcccccgaggcccgagcgtagtctctnanttttgcngtggttctccagtcctccctcatcngctctctanntttctctngtggngagtggtaacgacgtcaggngctcaggtcttgttcaggcccttcgcnggcgacgagcacacagcaaatggatacaggagctcaagctatgttcat

SEQ ID NO: 5682 - DNA, 145 bp, Zea mays
  misc_feature: Incyte ID No: 700350526H1
  unsure 8, 67, 100, 118: a, t, c, g, or other
ggtgccgngcaagtacaccggcgtcaacatcgcgttcaaggtggatcagggcgcgaacccgtactanttacgacgtgcttcatacgagttcgaggacgangacggcgacctcagcgcngtggacctcatggaggccggcagcggc

SEQ ID NO: 5683 - DNA, 151 bp, Zea mays
  misc_feature: Incyte ID No: 700350527H1
gcaaggcctcctgagcgttccatggagcaggagcagagggttgaacttgcgaacgaccgcgacgcgcagtccgtgctgcgtccggggaggtggaaagtgggcgcaggtttgctctgggggaggcggaagcggaagcggcagagggcgacat

SEQ ID NO: 5684 - DNA, 184 bp, Zea mays
  misc_feature: Incyte ID No: 700350528H1
  unsure 139, 156, 161, 166, 169: a, t, c, g, or other
aggtcaccggcgctaggagggcgtgaaatcgagtcgacggtcggcacccggcactcacgcgttctccacctactgctggcgctcctgtgaggcgacgccggaccggccaccccgcatgcgaacagcgcacggaccggcnaccggtgtgactcctcnatccnaaggnttnagtccagaccgagcc

SEQ ID NO: 5685 - DNA, 62 bp, Zea mays
  misc_feature: Incyte ID No: 700350529H1
  unsure 34, 38, 47, 56, 58-60: a, t, c, g, or other
aagccacgcggattcttccttctgcgtttatgcncctnctcgcaccngcactgcangnnngt

SEQ ID NO: 5686 - DNA, 150 bp, Zea mays
  misc_feature: Incyte ID No: 700350530H1
gttgaactcagcaagcaacaccatgccagcgacttgcaagagaaaaatagactttcacggatgttggagcacaagaatgctttacaggagagaatcatccaagaacgtgcagctgagtttggccgtctgaagaaagagagagatgaacgg

SEQ ID NO: 5687 - DNA, 311 bp, Zea mays
  misc_feature: Incyte ID No: 700350531H1
  unsure 219, 296: a, t, c, g, or other
ggtggttccaatctcggcagggatttacccacgcccaaggagatttgcaaggggctcgacaagtatgtgattgggcaggacagagccaagaaggtgctatctgttgcagtttacaaccactataaacggatataccatcaatctttacaaaagggatttgggtggttttgatggggaagctgatgacgacaacaatgtggaactagagaaaagcaatgncctgttaatgggacctactggctctggtaaaacttacttgcaaagacttagctcgttttgtgaatgtaccattgtantgctgatgcaacgac

SEQ ID NO: 5688 - DNA, 174 bp, Zea mays
  misc_feature: Incyte ID No: 700350534H1
  unsure 31: a, t, c, g, or other
aaactgtttgttagcgtgacgtgcgtgaggngtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaa

SEQ ID NO: 5689 - DNA, 174 bp, Zea mays
  misc_feature: Incyte ID No: 700350535H1
ttacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaactatgatgtccatgttctt

SEQ ID NO: 5690 - DNA, 174 bp, Zea mays
  misc_feature: Incyte ID No: 700350536H1
gccaggagcaaggattgcatttattggagacggaccattcagagctgagctcgagcagatgttctcaggtatgccggtggtgttcacgggcacgttgcaaggggaggagctatcacaggcctatgccagtggggatgtgtttgtgatgcctccgagttcagagacactggggtt

SEQ ID NO: 5691 - DNA, 142 bp, Zea mays
  misc_feature: Incyte ID No: 700350539H1
  unsure 2, 38, 63, 66, 101: a, t, c, g, or other
gnctccctgccctctcactcccgatccctcctccaccnccgcttcctccgcgtcacccctctngtngtcgcctacacgaggcgaccagcggcggaccctcngcggcgcaaccatggggctcttcactgtgacgaagaaggcc

SEQ ID NO: 5692 - DNA, 176 bp, Zea mays
  misc_feature: Incyte ID No: 700350540H1
tcccagctgccagcaggcagatcatgatccaacagctcctgtggggcaggctataggacagacgacaaaactcaactcacagaagaaccagtgtaccaggaacaatgggacagtgtcggtcagccaatgctgaggatgcccaagaactcagtgatgtagagagggccattgagacc

SEQ ID NO: 5693 - DNA, 106 bp, Zea mays
  misc_feature: Incyte ID No: 700350542H1
ggcaacatccggactgtggcatcctttgtttatgaagatgaaataatcaagaaagcagaattgtcactgcaagaacccttgaggatcaccaagattgagagcatga

SEQ ID NO: 5694 - DNA, 154 bp, Zea mays
  misc_feature: Incyte ID No: 700350543H1
  unsure 18, 25, 41, 57, 77, 88, 92, 95, 99, 106: a, t, c, g, or other
tctactcgatcggcagcngcaaganccgaccctccgctccnccccaaaaaccctagncatcccaggttgctccggcngcatccccgcngacngcngacngccgacngccgacgatgcctcccaaggccaagaaggacgctgcgccgtctgagcg

SEQ ID NO: 5695 - DNA, 157 bp, Zea mays
  misc_feature: Incyte ID No: 700350544H1
  unsure 2: a, t, c, g, or other
gnaaaggaaaatgctgaaagaacaaatggcgattttcgcattgtagcaatcgatactggtgtgccccgccgcccccctgtggggcgacgtgtccaaagatcatgagaggtaccccaaagttgtggaactccattttgaatagttcggactactcagc

SEQ ID NO: 5696 - DNA, 131 bp, Zea mays
  misc_feature: Incyte ID No: 700350545H1
  unsure 29: a, t, c, g, or other
gagatggatgttacaagccgtgaattggnaccagcaattactttgttacagttatacttgagttcatccaagcctgtgcttcgatttgctgctgtccggactctcaataaggttgctaggacacgacctct

SEQ ID NO: 5697 - DNA, 230 bp, Zea mays
  misc_feature: Incyte ID No: 700350546H1
  unsure 2, 4, 11, 52, 107, 153, 159, 162, 168, 200, 202, 214, 221: a, t, c, g, or other
gnanagatganccaagagatggtcacagtgatgttccaatgcttcccaatcnccgtttgatgtttcaggttggagggaatgctacgcatttggttactccatctganattatatcgggcactctctcgtacttctgaaaacaatgatgcttcnaaatcnganggaggnaaaagttcaagatgtttccagcagaagctctngngttccagaagtngaaccanagctattga

SEQ ID NO: 5698 - DNA, 258 bp, Zea mays
  misc_feature: Incyte ID No: 700350548H1
  unsure 4, 6, 81: a, t, c, g, or other
tgcngntcctgccacggtgacccatcggccaagcgccgcttcctgatcctgccttccttgctgtcaggccgtgtgtatgtncgtcgacacagcgacagacccaagggcgccatccttgcataaggtggttgagtctgaggacattgctgagaatactgggcttgggttccctcacacgtctcattgccttgcgtctggcgacattatgatttcttgcctggggacaaggaggggaatgcagctggcaatggcttcctg

SEQ ID NO: 5699 - DNA, 294 bp, Zea mays
  misc_feature: Incyte ID No: 700350549H1
  unsure 90, 103, 123, 147-149, 152-153, 158, 191, 204, 232, 270, 286, 290-292: a, t, c, g, or other
gtcattcgcgcgcacacgcggttcgcagctgcggtgcccggctcaacgccgcggagatggagggcgacgccaccggagctgacggaggangcggaggaggaantggtgagcgttctagcttcntgatcggcctcatcgagaaccgtnnnatnncaaantagtccacgctctaaaacccctccgcattttcnggttgctacgatnatccgtgcggattttgttatttctctantgacccgttatctccgaccggcgtcctccgttttcgtnttcgcgtggggtcgangcgnnnca

SEQ ID NO: 5700 - DNA, 293 bp, Zea mays
  misc_feature: Incyte ID No: 700350550H1
  unsure 182, 184, 214, 218, 227, 250, 252: a, t, c, g, or other
cgctacagcaacgtcgccacttcactcacgattggagtttcacctcggcagcccagccagccagtggttcctacggctacggaggaacaggcgaacagcaagagcttctgaagatgaaggcgatccccgtggctctcctgctcctcgtcctggttgctgccgcatacctacgttcaagcatntncgccgaggcagcagacggcggcgcggtgcngganggcgtgtgngacggcaatgccgcagccggtgntngctgaagaaggccgggcggtgctgggctgtgcataatgtgt

SEQ ID NO: 5701 - DNA, 288 bp, Zea mays
  misc_feature: Incyte ID No: 700350551H1
  unsure 238: a, t, c, g, or other
gggcgagcaaaggcaagtacaccattgggcttgggcaagattgcatggccttttgcagcgaggtggaggatgtcatctcaatgagtttgacggttgtcaattctctgctgaaaaaatacaagattgatcccaagctaattggtcgcttggaggtgggaagtgaaacagttatagacaaaagcaaatccatacaaaacttggctgatgcagatttttgaggaaagtgataatactgacntgaaggtgttgactccagcatgctgttatggtgggacagcagccctactg

SEQ ID NO: 5702 - DNA, 288 bp, Zea mays
  misc_feature: Incyte ID No: 700350552H1
  unsure 7, 64, 195: a, t, c, g, or other
gtgatanagatagcaccgcacctataacaagtgtgtcctggtccaggtatggccaccgtttgcntgcctctgctactgacaagtcattgacactttgggatgtgccaactggggaaaaaattgcacgtattactcttcagcagactccattacgtgccagccttcaacctggttctccaactccatctatttgtntggcatgccctctatcttctgcacctcttcttgttgatttgaatactggaagtactacagttctccctgtttctgtatctgagaatggtaacc

SEQ ID NO: 5703 - DNA, 291 bp, Zea mays
  misc_feature: Incyte ID No: 700350553H1
  unsure 93: a, t, c, g, or other
gggcaacatagttcactgttgaggaccattttgatcaatggggagaccagagttcctgtgtacacagtcttggaggtgtatcgagtttcagancatggagcttgtaagagttcttcctagtgtaggagaggaagtcaatgttgcatgttttcatccttcccctggatcaggtcttgtttatgggactaagcaagggaaggttaggtttcttcggcaccatggtgcatcattcacttgctggggagaacgttcatgaggtattactttcctaccattgaaggcttgtatgga

SEQ ID NO: 5704 - DNA, 286 bp, Zea mays
  misc_feature: Incyte ID No: 700350554H1
  unsure 40, 222, 239, 249, 277, 280: a, t, c, g, or other
gttcgctccgtgtccgaggagagcggcggcggcgcaaggngtcttcctgtaccgacgccggcaacgtacgacaccgctggcaaacttctctccgattgtccctgctccagtaagagtaggcgaggatgagcctcccccatcttgggtgttggtgcctgacccattttctcaagttttgctatggatatgagcaatagagatcaccttaggaggagggaggangatgatgatgacctctnctttcatctnccgtcccaacatctctgggctatctggnagntagaaa

SEQ ID NO: 5705 - DNA, 290 bp, Zea mays
  misc_feature: Incyte ID No: 700350556H1
cgagagggcaggagcagccgcagtcccggcgatcccgccgccggtccgccctcacacctcctcgtcactgccttcgtttctctttccaacaatcaagatgagccgtggcggtaggcgggtggtggtcaaagttctctgggttacctctttggaagcggtgagccccccaaaccagcagtggcaccaccagctgtaagtgctccacctgctgctgcaggtgctccacctgctgagaaaccacctgctgcaaagcctgatggcaccagtacagattgctgctggggttacca

SEQ ID NO: 5706 - DNA, 247 bp, Zea mays
  misc_feature: Incyte ID No: 700350557H1
  unsure 57, 148, 153: a, t, c, g, or other
ggtgaccaaggcggctgccaagaagaaatgatgcgataccgtgtctgcttttgcagngcctggataacttgccactaaagttgtgtatgcggttgttgctgttattgcgtggactgtttgctgcggtgtctcctgtttgtttgggtancgcangacggcctcttcaggttactgttgtctgttgtcttactatcagtaatgctcctgagacttgtattctcctttggcgccgctaaatggaatttcg

SEQ ID NO: 5707 - DNA, 289 bp, Zea mays
  misc_feature: Incyte ID No: 700350558H1
  unsure 194-212: a, t, c, g, or other
gacctattccttctcccagccgtcgagctgcccaacccagagcaccagcagccctacaccttcttcctctacggccggtccttcaaacgagcccgctcgtacttggagccgccgccggtactcgttctggacgaacgttcaaggagattgcatttgtggatgctctaatggagtcgaaaggtggcaagaagtcnnnnnnnnnnnnnnnnnnnttcatgtacgaagctccccttggctacaagatcgaggacgttcgcccagccggagaatcaagcagttccgactgatg

SEQ ID NO: 5708 - DNA, 151 bp, Zea mays
  misc_feature: Incyte ID No: 700350559H1
  unsure 90-91, 139: a, t, c, g, or other
gtggccatcgtgacggcgtccacgatggggatcggcctcgccatacgccgagcgcctacggtctggagggcgccgccgtacgtcatctcnncccgcaagcagaagaacgtgaacgaggcggtggaggggctacagggcnaagggtatcacc

SEQ ID NO: 5709 - DNA, 286 bp, Zea mays
  misc_feature: Incyte ID No: 700350560H1
  unsure 22, 25: a, t, c, g, or other
tcatcctgcgggagcaggagangangacgcgccttagggggctcgacgcgcagaaggccaacatcgcctcggccaaggccgtcgcgcggatcctccgcacgttcgcttggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaatcggggctggtaccaccggggtggtagttca

SEQ ID NO: 5710 - DNA, 283 bp, Zea mays
  misc_feature: Incyte ID No: 700350561H1
  unsure 9, 207, 219, 224, 232, 234, 243, 245, 252, 256, 268: a, t, c, g, or other
gcagcagcngctgcagcaccaccagccgcagctacgggaccgtgccccatctcctcgccggcgggtcgctggcgcagttcagcaagacctgcaccgccccgctcgcacgcctcaccatcctctttcaggtacaaggaatgcactcagatgtggctacaatgcgcaatactagcatatggcgtgaagcatcccgcattgtctatgaanaaggttttcgantttcngaaaaggnancttgttacntngctcacnggtngctttactcttnattagtttctatgcc

SEQ ID NO: 5711 - DNA, 233 bp, Zea mays
  misc_feature: Incyte ID No: 700350562H1
  unsure 105, 206, 211, 219, 230: a, t, c, g, or other
ggttgtgaagttggagaatggggacgggcctgtgacggtgggcggctcggtggacgagggtcgaggtggagatggcggtgacgacaaaggcctggctggtcagantcagcctgctgtgaaccagcttttgctggcgccggctgaggaggatctggcattgtccaagatctcagataattcttcatgttcgattacaccactggtgncgatnactcgggnacaaggaggancag

SEQ ID NO: 5712 - DNA, 214 bp, Zea mays
  misc_feature: Incyte ID No: 700350563H1
  unsure 196, 205: a, t, c, g, or other
gtgctttcagtgattaacctgaagggaaaggattaagtatagactctatgcaactggtggatctggatatcttatgaattgacagatatcaggatgcaacactaaatcaccccaactgacaattgggtatccgtttccaaatgctgctgtactgaaggtggttaagttggcccgaagacatgcttgttcattgctngctcttgtnaagatagtg

SEQ ID NO: 5713 - DNA, 293 bp, Zea mays
  misc_feature: Incyte ID No: 700350564H1
  unsure 2, 75, 139, 217, 290, 292: a, t, c, g, or other
gntccctccgcggctccgccttccgcccgcgaacacgccgctgtctcgaccccttgtccctacctaccttcagcnagatggcggagattgagataaagacagcacctgctgacttccgcttccctacaacaaaccaaanaaggcattgttttactcgctatgtcgagtaccacaggtgtttgaatgccaaaggggatgatgctggtgtttgcgaaanatttgccaagtactacaggtccctttgccctggagaatgggttgagaaatggaacgagcagagggagctgggntnt

SEQ ID NO: 5714 - DNA, 285 bp, Zea mays
  misc_feature: Incyte ID No: 700350565H1
  unsure 44-45, 208: a, t, c, g, or other
ctctttttctctcctgctgcagccttgcttcccgtcccatcctnnctttcccttgggcgcattcagcagcttcagcctggccggccggctgctattaaaccactttgcttgcaagtccaagaaactgctagagaggaacaagctgagatctccagcatggggaggggaaggattgagatcaagaggatcgagaacaacacgagccggnaggtcacttctgcaaagccgcatgggctctcagaaggcctacgagctctcgtcctatgcgacgccgaggtggcgttc

SEQ ID NO: 5715 - DNA, 288 bp, Zea mays
  misc_feature: Incyte ID No: 700350566H1
  unsure 2: a, t, c, g, or other
cnaagctccaactccgacgagaaccgccactcctcgaaatctcgaaggattttctgcggcgaaccccttcgtgacgtgacccaatgggagaggcctcgccgtacgatcgccaaggacgtcaccgagttgatcgggaacacgccgctggtgtacctacaacaaggtgaccgatgggtgcgtcggccgcgtcgccgccaagctcgagtccatggagccctgctccagcgtcaaggataggattggctacagcatgatcaggacgcagaggagaaagggctgattactcca

SEQ ID NO: 5716 - DNA, 277 bp, Zea mays
  misc_feature: Incyte ID No: 700350567H1
  unsure 51: a, t, c, g, or other
tgcagttctctgcattcgcaaaccagatgaaccaattgatctgtttatggnggaaataatgcacatgcgccacaaatttgatgttgacacccgtctggttgagggtctggtcctggaccacggttctcgtcaccctgacatgaagcgcagggcagagaattgttacatcttgacctgcaatgtctcattagaatatgagaaaagtgaaatcaatgcaggatttttttactcaaacgcagaacaaagagagaagatggttgctgcagagagacgccag

SEQ ID NO: 5717 - DNA, 281 bp, Zea mays
  misc_feature: Incyte ID No: 700350568H1
  unsure 48, 74, 150: a, t, c, g, or other
cgcccccatccgcatcaacacggggctcactctcttcacgctcacgcnccgtgctcgtgcccgcaatggacctncatctacgtcaaggggagggccgggctgtacggagcgttcgatgtgactgtcgccgccacggctctgtgcggggtngccgacgcgctcgtgcaaggaggcgtcatcggcttcgcgggggagctgcccgaacggtacatgcaggccgtcgtcgccggaaccgccgcctcaggatgcttgtctcggcatgagatttcaccaagcatgta

SEQ ID NO: 5718 - DNA, 280 bp, Zea mays
  misc_feature: Incyte ID No: 700350570H1
  unsure 153, 216, 236, 266, 271, 278: a, t, c, g, or other
cctcttcgtcgatacggtgtccctagcctccccctgcccggctgtcctcctcgatttcgcaagctcctggttacggcggcatctatacgttccgccgcaagggccgcatacgtctctactcgcgacgttgccccagaccgccgagataatggntggccaccgaaacagtcatggaaagcgccatctgattttactgaaaatggaggcataagagangaaatctggcgatgatactnatgcacctggtctgatgacatgtgtatcgntactntgtgctnta

SEQ ID NO: 5719 - DNA, 277 bp, Zea mays
  misc_feature: Incyte ID No: 700350573H1
  unsure 38, 41, 44, 47-48, 50-51, 98-99, 248: a, t, c, g, or other
ttgctctgtcctctctccaactccacgatttgttccanacnagntannannacatccgcagcgcttcttgctgaaaaagggaactccgagttctccanntctggatcggcagagagcggtggttccttttgcggactctgaggtccagttcttgtttttgatttgtctcatcaacccaccagtcgggctgcaggcttagagctggaaggaataatttgactagagaaatggggcatgttgcagcaagntaggccccggactctggacgggagtgcca

SEQ ID NO: 5720 - DNA, 277 bp, Zea mays
  misc_feature: Incyte ID No: 700350574H1
  unsure 2, 102, 214-215: a, t, c, g, or other
gntccatgttactgcagagcgtcccaccggcagtactggtccgatttctgagggagcatagatctgaatgggccgattacaatattgatgtgtatttggcancatcactgaagaccagtgcgtgctcacttcctgggttgcgacccatgagattttctggggggcagatgatcatgccacttgctcacacagtggagaacgaggagattctgannttgtccgccttgaaggacaacctcttactccatgatgaagccctcttcagggacatccactt

SEQ ID NO: 5721 - DNA, 274 bp, Zea mays
  misc_feature: Incyte ID No: 700350575H1
  unsure 12, 225, 245-246: a, t, c, g, or other
ttctccggagcncccccaccaccaaacacagctaacagcttggtgggatggggggaaaaggcttccctttggcttgcctgtgagtgggatctcttcttcctcccccagagcccctgccctcttccgccgacagcgagaaagcacgcggcgcacagcaacacgtccctgccgttccttttgactccggggatccctctcctcttgcttgccgaggaacccactagnttcaaatattccctgggtcnntagatccctctcccgttcctaaaaaaaa

SEQ ID NO: 5722 - DNA, 283 bp, Zea mays
  misc_feature: Incyte ID No: 700350577H1
  unsure 33, 125, 221, 261, 269-270, 278, 280: a, t, c, g, or other
tacgcaaaggccaacccatgctggtggcaaggncggagcaaaaggcgacaaggctatgctgtacatacaagagatgcgagcgagagaccactgaaagctgagtggagacgctgaggtggcgaatncaaaaccccaaaccctaccatttggttagtgcaactatttgggtcggtggatggcgtctgcagtttgctccgattgttttgcttgttatgtaaaanagacgttatcatcttatcccgcggcgatgaacgggttcantttgttgnnaaaatccncnggg

SEQ ID NO: 5723 - DNA, 50 bp, Zea mays
  misc_feature: Incyte ID No: 700350578H1
  unsure 29, 31, 34, 41: a, t, c, g, or other
ggtgcagcggactgcgcccgtgcctgtgnangtncttgtanctacaatac

SEQ ID NO: 5724 - DNA, 284 bp, Zea mays
  misc_feature: Incyte ID No: 700350579H1
  unsure 2, 21, 31, 155, 186, 218-219, 256, 259, 266, 276, 279-280: a, t, c, g, or other
gnggatggctgccctaacacnaactacaganggtcctcgcctcggcgagcaggagatgaagaagatgtctccctccttccataccaactctgtggggagatttctttctttcttacgaggctccgaccgaggcacaggaagctcaaatgagaganaaggctggagtgctaaaggaagaagtgaganacatgattaaaggttcacatgatgtgcccganntagtggaccttattatcaccctgcagcgactaaatcnggntaccatncgaggatganatnnccga

SEQ ID NO: 5725 - DNA, 172 bp, Zea mays
  misc_feature: Incyte ID No: 700350581H1
  unsure 70: a, t, c, g, or other
tatacgtacagttaatagcagctagctgttggtgtggattgctatgcgttagtagcctatagtaggtaanaggaggcatcactcatctcactataggctactatacgtacagttaatagcagctagctgttggtgtggattgctatgcgttagtacttgttaaaagaaaaaa

SEQ ID NO: 5726 - DNA, 280 bp, Zea mays
  misc_feature: Incyte ID No: 700350582H1
  unsure 2, 142: a, t, c, g, or other
gngagtaattactgaactagttggagaactgcatcttgaggggtctgtgaaaacaacaaaattgaagatcacatggctagcagatatagaggagctagttcccctttcattggttgaatttgattacctcatacagcaaganaaagctagaggaagacgaggacttcctcgacaatctcaacccttgcactcgacgggaaatcccagccctggagatgcgaacatgaggtacatcaagcgtggagaggtcatacagctcgagaggaaggctatataggtg

SEQ ID NO: 5727 - DNA, 280 bp, Zea mays
  misc_feature: Incyte ID No: 700350583H1
  unsure 3, 75, 78, 82, 85-86, 248: a, t, c, g, or other
ggnaacttctgagtggcgacaaggagggtcttcttcagctcccaagtgacaaagccctgctgagcgaccctgtcntancacntannaaaagagaaatatgctgcagatgagaaggcattctttgatgactacaaagaggcccacctacaagctctaccgaactggggtatgctgatgctaaatgtccatatcctggagcgggacacaaactgctgcctgtatggactcgtgcgattcagggtgaaccntcagattgtctagtgtctcttgtaataattta

SEQ ID NO: 5728 - DNA, 281 bp, Zea mays
  misc_feature: Incyte ID No: 700350584H1
  unsure 6, 11, 14, 23, 28, 30, 36-37, 41, 87-88, 94, 96, 116, 120, 129-131, 136,: a, t, c, g, or other
ggcctngaganatntatacactntctancnatatannattnataatgcagcaaaagaagcactagaagggcacagcatctatgaaanngtactncnaactgcacctcacattttcncgcnatactgaannncaatnttaaggttaacaatgagcgaggtagagattataccaaggggaatgccactccaagcagtgatacaaccttccattcttggtcctacanccaataccaagcgttggtgntgatattccaccagcacagggtagtgttcttntgnaa

SEQ ID NO: 5729 - DNA, 275 bp, Zea mays
  misc_feature: Incyte ID No: 700350585H1
  unsure 45, 240: a, t, c, g, or other
gcatttctccttatgctattttcaaatatcatatttgtggcaganatgctatttggcgacagtggctggatgaacaatctgaaaggatatactggaagcctgtggtgctcccatatactgttttagttttagttgcacttatatctgtggctttttcactgtacctggctgttacaccattgagatctggaagtcatgaagctgaatcccatgaatggtctgtgcatctcagagagaacnctgaatacttctcaagaaagagaagatgttaaggt

SEQ ID NO: 5730 - DNA, 274 bp, Zea mays
  misc_feature: Incyte ID No: 700350587H1
  unsure 41, 232, 244, 248, 257-258, 268-269: a, t, c, g, or other
caaaacagctgtaattgtaggaaaagttgcaatcacaaaanacccttgtctccatcctggtgatgtcagagtacttgaagctgtatatgaccctggattggatgctaggggtcttattgattgtgttgtatttcctcagagaggggaaaggcctcatccgaatgaatgctccgggggcgatttggatggcgacctcttctttattacttgggatgacaaactgtttccgganaaggttgatgcnctanggactatannacgaggggcnntcata

SEQ ID NO: 5731 - DNA, 277 bp, Zea mays
  misc_feature: Incyte ID No: 700350590H1
  unsure 101, 120, 258: a, t, c, g, or other
tgttgatgattttgaggtgcaacctgtacatacacaatccacatgcattgccacttttcagagatcaaccaagttcgtaagcgtcaaagagagaagatacngaaagacccactacaaatncccacaaaccagaagcacctgttaatggtccaggttttggtggaagagttggtactacaaaaggcagtttgctgacacagtatctcttgaaggaaggtggtttaattaaggagactggatggatgaagatccagagangccttttgaagtatgctga

SEQ ID NO: 5732 - DNA, 276 bp, Zea mays
  misc_feature: Incyte ID No: 700350591H1
  unsure 5, 30, 58, 93-94, 209, 235, 238: a, t, c, g, or other
gtganaaagacatcctcagcaggatactgnaaagaagagagtaggtgctaaaggagtnaaacatgaccaaatcatttacgctgctgatatccnnaaaggcaatctaccaccaggagcggctgatgtagggttttcttttcctccacctttgcattctgggaaaaatacatgagtctgatgctaaatcttgtggtcaaagaaggatgagntgtattgcattaatgatcctgatgangtncaaaatggcatggtatccaatgatatgcttgccactgg

SEQ ID NO: 5733 - DNA, 217 bp, Zea mays
  misc_feature: Incyte ID No: 700350593H1
  unsure 45-46, 107: a, t, c, g, or other
ctagccgctgcgggtctgcctgcaccgcgtcgcgtacgccactgnnaccgacccgccacagccccactagcctgactccaccgccaccctaggtataacctctattnccgcatcatggtcgtagatcacgtaacccagttaggcgtctcccgttcgaaagagatacggtgtagatatgcagatctttgcatatctacaaatgtatcagtttcgattg

SEQ ID NO: 5734 - DNA, 279 bp, Zea mays
  misc_feature: Incyte ID No: 700350595H1
cctctccgcacacaccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctacacaaggcccacccgccccgacaaggcccgccgcctcggcttcaaggccaagcaggggtatgttgtttaccgcgtccgtgtgaggcgtggtggcaggaagaggctgtgccgaag

SEQ ID NO: 5735 - DNA, 281 bp, Zea mays
  misc_feature: Incyte ID No: 700350596H1
  unsure 17, 54-55, 126, 179, 189, 225, 234, 253, 268: a, t, c, g, or other
gtccttgctcgtatgcnccacctacagcagctgcttgacaggttccttgcttgnngccccaccggtggggcgaagcacagcaggatggtgctggttgcgctgtatcagattgtgagggagagcttncagctctacgccgatatctgcgaggtgctggcggtgctgctggacaggttctntgacatggantatgctgagtgcgtgaaggcttttgaggcttatgcnagtgctgcnaagcagatcgatgagctcngtgcatctatgcatngtgtaaagatacc

SEQ ID NO: 5736 - DNA, 309 bp, Zea mays
  misc_feature: Incyte ID No: 700350601H1
  unsure 66, 74, 267, 301: a, t, c, g, or other
tgtgaatgggttagctgggccactacatggccttgcaaatcaggaagcgcttctatggctcaagtntataattncaggaaacagggagcgacgttacgacagaccaactcaaagactatgtctggaagacactgaagagtggaaaggttgttcatggatttggtcatggagttctgcgtaggacggacccacggtatctatgccaaagggagtttgccctgaagtatttgccagaggatccgcttttccaactgctgtccaagttanatgaggtcctgcctccgatcctcatgagctgggnaaggtcaa

SEQ ID NO: 5737 - DNA, 305 bp, Zea mays
  misc_feature: Incyte ID No: 700350602H1
gcctcatggtggactccagcgccatggtggggtggatcggcaagacggggctcccgcacatcaagccgttctcgctggggggcaagaccccctcccaggtggtcgcggaccagggcttcctcgtctccagcgacaaccacaagcccaccgtgctcgtgcagcaggccaagatctacctcgccttccagctcagcttcaccgagccgctcaggcgccagaacgtgctcctcgccgtcggctccgccatccccgtcaacgaccgcctcgccgagcaccaggataagacctccatcgtattcgtttca

SEQ ID NO: 5738 - DNA, 245 bp, Zea mays
  misc_feature: Incyte ID No: 700350604H1
  unsure 24: a, t, c, g, or other
cgtctccactctccagtctccagnactgctccgcgcgcgccggatcgagggagggcaggcggacgaggaggagagatgagtctcttcgggcttggacgaaaccagaagacattccgccccaagaagagcgctccatcaggtagcaagggagcacagtccgaaagcactagatgccattctcggcagtggaaacttagggaagctgtgaggttgctctggagaggatatcatgatggctgcggtga

SEQ ID NO: 5739 - DNA, 298 bp, Zea mays
  misc_feature: Incyte ID No: 700350605H1
  unsure 2, 29, 198, 210: a, t, c, g, or other
gnaaaaaccagagatgcttactataatanaaaactgtgcagttataagcatagcttgctgtgtgttttacagccactgtggtaacaggactgtttcaagagacaaatctattgatcgtagaactgctagctggattgtattctcactttggacaaagcatgatgacaacacactgatttcaaggctattgcgtatgcntaaatttaaagnacagatttgctcctccggtttgctccagttggttctgcctagtgattaccctcttctctctaaatgggccattatggagattgtctcc

SEQ ID NO: 5740 - DNA, 230 bp, Zea mays
  misc_feature: Incyte ID No: 700350607H1
  unsure 36, 55, 65, 113, 120, 160, 163, 197-198, 219: a, t, c, g, or other
ggatgaagaaccccgacttcactgcagacaaagcgntcgccaaggacttcctgtncaacttcgtnggccctcacggcgaccccaagtacctgaacatcctgcaagatgtcgcnaacaggnaagatacgcgcggtccagatcgagctggacgacctgtttnatnacaaggacgtcgatgaggagttctgcagcgtgtnnatgagaacagcggcgtacgtnggcatcttcgg

SEQ ID NO: 5741 - DNA, 295 bp, Zea mays
  misc_feature: Incyte ID No: 700350610H1
  unsure 41, 105-137, 204: a, t, c, g, or other
ttagcaaaatccaaggatgacgggggttccaagaagctgtntgaggatgcaaatggttcggctccggctgctgcatctttgtacagtcgctgttgacttggtccnnnnnnnnnnnnnnnnnnnnnnnnnnnnnnnnnaggagccgctaatccaggccgcggagtgccgcatatgccaggaggaagatagcgtgaagaacctcgngaaaccgtgtgcttgcagcggcagttctcaagtatgctcacagagcttgcgtgcaacctggtgcaacgagaaaggagacattattgtgaat

SEQ ID NO: 5742 - DNA, 296 bp, Zea mays
  misc_feature: Incyte ID No: 700350611H1
gacaatgggatccaaggatgcagggaccggtgctcaggccacgctggagagactggtgtccaagcacaggcatcggcgtgaccctgatggccccccgtttgaaggcaggttttccgacgagtcatcatctttgctggagaggacgcttgaaatccgggacaggtcctacaggctcaagatcggtgtgatgagcgaaggcatccctcctgtatatggtgacgatgaaagcgccgccagtgctgctgattcagatggcgaggagtttagccgaaacgtcaggaagctgcggagatctg

SEQ ID NO: 5743 - DNA, 296 bp, Zea mays
  misc_feature: Incyte ID No: 700350612H1
  unsure 2, 11-12, 21, 23, 32, 53, 58, 65, 68, 70-71, 74, 153, 165, 168, 230,: a, t, c, g, or other
cncaaaactanncccctaatnanattaattanccactccattcatcgacctcnccacnccatgcnagnanntcngcatgatgaaacttcggctcactccttggcgcctgcctgatcctccaaatacaccacaggactattcctagccatgcantactcaccagangcntcaaccgccttttcatcaatcgcccacatcactcgagacgtaaattatggctgataaatcgntaccttnnaggcnaatggnccnnaanattctttancngctcnccnaacanatancnnnncataccg

SEQ ID NO: 5744 - DNA, 294 bp, Zea mays
  misc_feature: Incyte ID No: 700350613H1
gtctatcgtatgtcgttgtctctccaattattcttcaaaatacatgcctgtgcattaccatgtacgtaaatggaaagcaaggtagagttgttctcagccgtgcgtgtagggtgtgtgtttgatgaaatatcctaccaaattttttctcatctattaccattacatggcgtgcttaacacatattcatggaatcacggttgcaagagcatttgtattgtgttgttaagcaccttgcatatttgatacataattgttgtgcatatctaacagtactaattgtgcttttgcaggtcc

SEQ ID NO: 5745 - DNA, 297 bp, Zea mays
  misc_feature: Incyte ID No: 700350614H1
  unsure 33, 39, 44, 49, 53, 83: a, t, c, g, or other
ttcatccctgttgacccgacggtggcgctcatntcctcnccganggtgntgtncgttcttccccccgacggttctccccatcnacctgctggcttcccttcgtcttccccgacactgatcctcaccactcatgtctgctgtaagttgccggaggaaacccttatttcctctcatgctacttctggttcatatactgcataaaattccgagatttcacttgatacaagtggaacactaggagttttgtgcaaatattcctaccatgtgaatcagttgtagctggtgaattggcaagac

SEQ ID NO: 5746 - DNA, 304 bp, Zea mays
  misc_feature: Incyte ID No: 700350616H1
  unsure 43, 107: a, t, c, g, or other
cttcctcacccgcccgcgccccgtgtacctgctcgacttcgcntgctacaagccggagtcggagcgcaagtgcacgcgcgagaccttccatgcactgctccaagctncaccggatccttcacggacgagaacctcgagttccagcgcaagatcctcgagcgctccggcctcggcgaggacacctaccttccccccgccgtgctccgggtgccccctaacccgtgcatggacgaggcgcgtaaggaggcgcgcgccgtcatgttcggcgccatcgaccagctgctcgagaagacggtgtcaggcc

SEQ ID NO: 5747 - DNA, 302 bp, Zea mays
  misc_feature: Incyte ID No: 700350617H1
  unsure 6, 267, 287, 292: a, t, c, g, or other
tgaganaacttgctgaacctaaaaccaacagttcgactggccatactttgaattccaagtccagcaagcgtggaccgcccgcggagaaaaagcatgccacaagatagccagacaaagaaaatttcagctataatgcagcttgaccagagtaaatcagcaacactaccagaactgaaggtcaaatactcgcaagctcctgctgttgtgaaaaatgcagtagctagtagagagaaaaagaggttcagtggagctaaatctcttcgtacnacagaaactgctagtgtaanggaanccacggtaac

SEQ ID NO: 5748 - DNA, 296 bp, Zea mays
  misc_feature: Incyte ID No: 700350618H1
cttggagctgcgggatgtaacagcataacagatgctggtatatctgctctggctgatggctgtcatcacataaaatcactagacataagcaaatgcaacaaagttagtgatcctggagtctgtaagatcgctgaggtttcttcatcatgcttggtgtcaataaagctattggactgcagcaaggtgggagataagtccatctattcgttagctaagttttgcagtaacctagagactcttgtcattggtggatgtcggaacattagcgaggctccatacaagcattgctcttgcct

SEQ ID NO: 5749 - DNA, 300 bp, Zea mays
  misc_feature: Incyte ID No: 700350621H1
  unsure 62, 125-126, 132, 147, 170, 282, 298: a, t, c, g, or other
ttcaccctcatctgtccgtacgcgactcgccgcaggaagagggccgcgggcgacgacctctngtcggcggtggacatggatgtcgacgccgacgcgcaggcgccaacggacaagctgaaagcaanntcagangcacttgggcatganatccgggttttttcaagtgaganctttgcttcacaaaccagcaagttgcctagtaccagatcatgaggaagatgacgacttttatgagcttccagcctgctgattactacaacttgatttccaaacaggatgggngagcctttaaaatgcnga

SEQ ID NO: 5750 - DNA, 284 bp, Zea mays
  misc_feature: Incyte ID No: 700350624H1
  unsure 2-3, 246: a, t, c, g, or other
gnngaacaggaatatggcgtcgcgcgcgcggtgggtggaggaagccggcgctgcggaggtggtggagaacaggggcaagctgtggctgaccaccggtgtcactcgggggggcaagctgtactacaacgttgaggagaccgggttcttggccgaaatgggtgccttgattcttctcaatgataaggatgagacgataggaattgaagatatctatgggaagcttgctggaggaattatgggtgcccngggatactttcagcttataagcattgaatcattggata

SEQ ID NO: 5751 - DNA, 265 bp, Zea mays
  misc_feature: Incyte ID No: 700350625H1
  unsure 3-4, 8, 15, 23, 68-69, 71, 73, 79-80, 84, 86, 91-92, 108, 111, 115, 134,: a, t, c, g, or other
ttnntgcngagatgntgggaagntactccgactgatcgcccttacatttgaggagatcattcctgaannanangatatnnaggnanaagcnnagagaacatcaggggnaangagncagacagaggagtgaccantcatnncagtnaagattgtttnacnccctcctgtgacatanatgtngacaattgtctgcanntggatcgctaaaatgctgagaagtagcanatcatgcagttttgatgccatggnaaaaaagtagtgaatt

SEQ ID NO: 5752 - DNA, 69 bp, Zea mays
  misc_feature: Incyte ID No: 700350626H1
  unsure 2, 26, 65, 67: a, t, c, g, or other
gncccctaacaggggccctctcagcnctcctaatgacctccggcctagccatgtgatttcacttncnca

SEQ ID NO: 5753 - DNA, 279 bp, Zea mays
  misc_feature: Incyte ID No: 700350627H1
  unsure 22, 158, 161: a, t, c, g, or other
ccattcacgccccgtctctttngtggccttccttttccggcggccacaagtgggcgagcggcggcgcccttacaccaggtcttcgtcgggcccttcaccggcgacgagcatccaccagaaacgtggagctcagagcattggtgcctctttcctctttnacnaaggattccggtgccttatttcacaagacaaaaaaagtctcaagggtcttgattcttgtatgaatacaagatttatggtggatcttggagctgtgggatgctaagctggtctagctat

SEQ ID NO: 5754 - DNA, 291 bp, Zea mays
  misc_feature: Incyte ID No: 700350628H1
  unsure 7, 15, 77, 231, 246, 272-273, 281, 285, 288: a, t, c, g, or other
gtaaganggcgagtncgacgggaggcgcaatgcggtggagatctcccgccgtgctgcggctgcagctgtggctgctncgccgtctccgcgtcgttggctgccctcggtgttctcgcggctgatcttagcaaagaaccatttactatccgtataagctgtggaagctttgacgatgtccggacggagcctacgaacacattgtggtacagagactttggttatactggaggnaggttcgctaatgcnacccggccaagctttaacgttcctcnnataaaagncttnganatc

SEQ ID NO: 5755 - DNA, 292 bp, Zea mays
  misc_feature: Incyte ID No: 700350629H1
  unsure 108, 201, 203, 213, 228, 239, 291: a, t, c, g, or other
gtaaacacccatcttggagtaggtgagtattgttatttagcggtggtgctaagaggtttaaataatgtttaatgatacagaacaacaagttttaggtttttattgacnacacaatctagtacaaaaacagggccttttagtcccaattaagttggggtaggctagagatgagaccctacggaaaggaaaactcatataaantntaaaaaggcntaacactcccccatncacataatatnaggcgtatgtttcattgtgacgaccgacgagcccttgaccaacattattatnt

SEQ ID NO: 5756 - DNA, 291 bp, Zea mays
  misc_feature: Incyte ID No: 700350630H1
  unsure 64-86, 130-131, 146, 153, 168, 209, 214, 243, 254: a, t, c, g, or other
gaccggagtggcatttgaccagctggagtcaacaggcatgccgaacggtggcggcaagaggtgnnnnnnnnnnnnnnnnnnnnnnnggtgggttctcctcctcggcagcctccagctcccggcggccggnngccacgtcgtcacgngcatgcncgggttcgacgggcnacttccgttctacctcgaaaccgggtacgtggaggtggacnagcancaaggtgtgcagctctctactacttcgtntgctcggagcngacccctacgaggacccgctgctgctgtggctgttcg

SEQ ID NO: 5757 - DNA, 295 bp, Zea mays
  misc_feature: Incyte ID No: 700350633H1
  unsure 2, 14, 21, 23, 34, 67, 69-70, 87, 99-100, 115, 137, 139, 159, 174, 184,: a, t, c, g, or other
gnagcacgagcagnccgctcnantcctcccctgncgaagctccacacagcagaagcgaaaactgcangnnggccaatcgggcctggnaggaatgcttgnncgctgccgcaggtgnaggctacccgcagccgtccganangcacccaggagcaagcgcgnatccgccatggatcnggcgtccgangagctcaagngccgcagccgctatcttcaactcgntcatcngcgtantaagctcagcgnaancctgctnccctctcctaagnnggagcgaacccncanctgggcatgcgnc

SEQ ID NO: 5758 - DNA, 289 bp, Zea mays
  misc_feature: Incyte ID No: 700350634H1
  unsure 23, 198, 216, 222, 235, 256: a, t, c, g, or other
aagtccgagggaaagggagaggnagccgaggcggccgtggggagggacgagaagatgaggcgtgcgatggaggacgagcggttcgcggcggcgcggactgacccgcggttccggccgatgcggaggaaggaatccaaggtggcgctggactcgaggttcagcagcatgatgacggacccgaggttcgcctcgtcggcngcgcccgtggacaagcgncgggangcgccgcaagaanacgcgagatccccatgctgcntactatctcaaccaagaggattggaggatgatg

SEQ ID NO: 5759 - DNA, 105 bp, Zea mays
  misc_feature: Incyte ID No: 700350635H1
  unsure 11, 18, 21, 50-51, 60, 64, 70, 101, 103-104: a, t, c, g, or other
ggatccgccancatgggncgngttcgcaccaaaaccgtgaagaaggcggnncgggtcatncatnagaaanagtacttacacgcgcctgggcaacgacttcntnnc

SEQ ID NO: 5760 - DNA, 278 bp, Zea mays
  misc_feature: Incyte ID No: 700350637H1
gtagttgacatgatactgacccttttggttgtagcataagctgctatttatcttgatctgttttatttgattaagatacagcgagcaagctgcggccttcttttgcttcgatccatctccacttgtttttttgctggctggagtttcttttaattgtttgcttagctctgcagcttcgatttgttccgaaacttgttgatctatctgtgctatgttgctcagatcagctcgcaaggaactaacacacttatttttagatctagaatctgactccatac

SEQ ID NO: 5761 - DNA, 285 bp, Zea mays
  misc_feature: Incyte ID No: 700350638H1
  unsure 6, 8, 161: a, t, c, g, or other
cgagananatccggagcagccgcagtcccaccgaccccgccgccggtcgccctccatctcctacgccgctgcctctccgtttctcttttcaataatcaagatgagccgtggtggtagtgccggtggtggtcaaagttctctgggttatctctttggaagcngtgagccccccaaaccagcagtggcaccagctgcaagtgctccacctgttgagaaaccatctgctgcaaagactgatgcggccaagcagttgctgctggggttaccagccaaaccattaattac

SEQ ID NO: 5762 - DNA, 284 bp, Zea mays
  misc_feature: Incyte ID No: 700350640H1
gtgcgttgttcgagtgaagggggagaaagaaaccgctgtgccgccggcggcgaggaagggacgcaggaggcgctgcgtgagcgagcagcacaagtggaagcccaagggagctgtggacgaggacctgtacaagatctccccgcagcttctctgcaagaagaagctgctgaggaatttgcttggagggtgcctcggcttgggctgcatcgcctgatagtgagagatgcagagcttaataagtttcttgaaagttcgcttgcttggtgctctggagagattgtata

SEQ ID NO: 5763 - DNA, 252 bp, Zea mays
  misc_feature: Incyte ID No: 700350642H1
  unsure 198: a, t, c, g, or other
agacctaagtcattctccgcagtgcttggtacagatatgatatctccttgtatccgctgttagtactcgtacagtttgaggttcgtgtggtgatgctgctaggtactagatgggtggtattccaccaattggcctgaagatgtcctccacattcgttggcaactcaacctccatccaagagatgttccgccgcgtcanagcaagttcacggccatgttcaggaggaaggctttcttgcatggtacacagggg

SEQ ID NO: 5764 - DNA, 282 bp, Zea mays
  misc_feature: Incyte ID No: 700350643H1
  unsure 272-273, 281: a, t, c, g, or other
gggcatgcaaggctatttggtacctagctcatgctgttgacattatgtccattggtgcacaccatttttcatttcccttagctaattcatggcgacagatacattcaatgcaagagcaaagttcaaaggcagattcaaactctaccaatctgattaacatatttgtcaaatcatttctcgcctcacgaccaattcaggttgcagtttaccactgcttgcataatggtctagaatcagctattcatgcttgtctcagcttatctcagggcctnnctcagaang

SEQ ID NO: 5765 - DNA, 282 bp, Zea mays
  misc_feature: Incyte ID No: 700350644H1
  unsure 13, 117, 126, 132, 153, 238: a, t, c, g, or other
atttccccatttncattcccatcccaattcccatccgtttcatttccacctccttttccagtttcgactcgattcgaaacaggataccaaatgcatgatcgatcccacaagccgcanccggcggangccggnaacggcgggccggctggcganggcggcggcgggaacgtggatcgggtgctcttcaagaacctcgtcgagatggtgccgctcgtcgagtcgctcatggaccggaggntcaacccggcatactcgcgtcgcgcttcgctggtctacaggcgg

SEQ ID NO: 5766 - DNA, 282 bp, Zea mays
  misc_feature: Incyte ID No: 700350645H1
  unsure 42: a, t, c, g, or other
gctggacccgccgcagcctcgccgtcgtcggcctcttcggcntcgctgtccccatcctcgtctacaagggcatcgtacgcgaattccatatgcaggacgaggatgcaggtcggccatacaggaagttcctgtaagcggcgtccagggctgcaggatacgtcgattcctcgaccggggctgcgaggaggggagtttccgttcagtttgtgtcggtattgttttagtctgaatctgatgaagcatttggaatgctgaattatgtgcctgatccaatgaataagg

SEQ ID NO: 5767 - DNA, 290 bp, Zea mays
  misc_feature: Incyte ID No: 700350646H1
  unsure 28, 115, 278: a, t, c, g, or other
gttacaggtctggccgtgcgtccccatngtcaaggccaggaccaccacatccacatggtcggcagccgcccagccaagaagcctaagaacacggggtactatgccgaagggtgtnccgagagcatgctcggaagcaggaacgagagcagcagtgccatcaggcgtgagcaagaagaggtggtagagttgctgcagcttcgtagaaaaggacggcgtgtctcagggatctgagctgttctttcatagctactgagctgtttaggtcgccgatccgacgnggggatttaggt

SEQ ID NO: 5768 - DNA, 287 bp, Zea mays
  misc_feature: Incyte ID No: 700350648H1
  unsure 4-6, 8: a, t, c, g, or other
tttnnncngtctcaactcaattgggcctgggcagacgagtgtgtcttcaacctgtgtctacttcgattacacagtgttgttcatagcagcctagccaatgcttataaatcctggttgataacagtgattcaccgaacacactcaattggccaagatcatttttggcataacgtggataggggtgtggtgtgtggaattaaggatagatgctgtgcagattggcaaagctagttttatctgctacactgacacaagattctggcaagctttctcaattgaattgcacc

SEQ ID NO: 5769 - DNA, 316 bp, Zea mays
  misc_feature: Incyte ID No: 700350650H1
  unsure 242, 262, 265-266, 284, 289, 296, 303, 308, 313: a, t, c, g, or other
tctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgctagaataaagttggtggcgatcgattngattcgatctttggtgatgngtnnccctccctgtgtgttgtncttanttccagncgttatnaagtnattantta

SEQ ID NO: 5770 - DNA, 311 bp, Zea mays
  misc_feature: Incyte ID No: 700350652H1
  unsure 11, 170, 276: a, t, c, g, or other
tcaagtctcangccgactacatcagcgtgccgatcgagggtccctacaagcctgcccactaccggtactaggcagccagcacacggcttgcagctcactcgggccgttgtgtgctatgaagttcgctacactggcctgtacagttatcttttgcatgcatatgcattatncatatacgcatcgcgtagcaggtttcctatggttatcgcttgagctgagggggagggaaggagctgtttgcttttgctgaagataatggtgtagtcggctggggtnaggcgatgtgcgttgccagatacattttgttctgg

SEQ ID NO: 5771 - DNA, 308 bp, Zea mays
  misc_feature: Incyte ID No: 700350653H1
  unsure 42, 50: a, t, c, g, or other
ctgagcgtacattctctcctctctctcttggcggcgactcgncgaccggngctgctgccccacgtttggtgcccaggtcttcgtgggccccttagccggcgacgagcatcaccagctgaaagatggcgaggataccgtctttgaagagcctcaatgcgtttccacatgcggaggaacacttgttgaagaagacttactctggtgctgttgtgacaatctgggctacttataatgattacatgtttgtacatgagctgcagttttatctcaccacatacacatgcatcagatgtctgtagatctaaaac

SEQ ID NO: 5772 - DNA, 312 bp, Zea mays
  misc_feature: Incyte ID No: 700350656H1
  unsure 48, 59, 80, 115, 127, 154, 231, 245, 262, 285, 288, 300, 308-310: a, t, c, g, or other
gtgccgccgccgcctcctgggaagagaggaagcgggagaggagcccantctcgcctgtncacccaatatctaccagccgngcagtcccgaagagtgtaagatgttcgcctgcgcnaagctacgctgnaccccctatctgatccgagctggatcnagagttgcatacagaccaatttctgcatcagtgttatctcgaccagaggctagtaggactggagagggctctacggnatttaatggggccnagaatggtgtgtctcancaaatccaaagggatttcagacnatncaatcagcaganacttagannngc

SEQ ID NO: 5773 - DNA, 231 bp, Zea mays
  misc_feature: Incyte ID No: 700350657H1
  unsure 123: a, t, c, g, or other
cagacgacgagatggccgatgcggaggacgccgccgccgcgcgccgacgggccgccataaccgactaccgcaagaagctgctcaactgcagggagctcgagtcgcgcgtcggcaccgtgaganaaagccttaaaaatgcaaagagggatttaccaagactgaagacgacttgaaatctctgcagagcgtggggcaaataattggagaggttctccgacctcttgataatga

SEQ ID NO: 5774 - DNA, 185 bp, Zea mays
  misc_feature: Incyte ID No: 700350659H1
  unsure 2, 27, 52-53, 80, 183: a, t, c, g, or other
anttctcggactgcaggcagccaggcncgcactagcaacaccccccacccgnnggctcggagcggggccccacccgaatncacacagatcgggacgccggaggaggagcaacgccgtcccgcatcaccggagcaacgcgggcgcggagaggccagccagcgcaggcgcagttcaagttttggntt

SEQ ID NO: 5775 - DNA, 311 bp, Zea mays
  misc_feature: Incyte ID No: 700350662H1
  unsure 2, 5, 197-198, 236, 247: a, t, c, g, or other
cnaanatttcccccgttcctgtctctgcttactcacctctcccatgagacgaagcataaaatcaaataggatatgtgggttggaaataggtcgtgaaattgattgaaatacctggggcttgagcgtgatatatagagggtggtagagaccaagcgacgttgggcgagcggcgccgccggggctgcgttggtcccttnnaccggtgatgagcatccaccagatacaggaatgaacancttgtgtaggnacctcgtccagacatctaaggcgaaaattgctgcgcctgcaccaccatagtgcacctgtctctc

SEQ ID NO: 5776 - DNA, 298 bp, Zea mays
  misc_feature: Incyte ID No: 700350664H1
  unsure 4, 10, 15, 32, 40, 50, 54, 57, 64, 82, 88, 101-102, 122, 124-125, 133, 135,: a, t, c, g, or other
tggngcctgngcttnggaaattggaggatctncagtattngtaagtcctnacanaangacaggnctgggtttgacggagttngacgtncaacctttgatcnntgataattcttcaagtatgngnnatgttttncntgatatgtncntggtaggtgtgacctgnttgatactgaacgagganaactgtaggtgaaantgggatnaggagacctcagtntaaaggtgaaacngagtgagtgttnacganaggttcagcatatgggtcctatgttatgntnagtttgagaaagtgatctga

SEQ ID NO: 5777 - DNA, 307 bp, Zea mays
  misc_feature: Incyte ID No: 700350665H1
  unsure 89, 100-101, 240-241, 250, 253, 255, 260-262, 267, 273-274, 276, 278, 280,: a, t, c, g, or other
gttatcgtggtccatcgtgcaacttttattgtcggtttctctgattcaattaagtgggaacccttggtagtgattcaattaagtgagangtgagaacccnnattgtgctattttttgtttcagggttgttatctatctttgtagccgaagaaacaatcctgagaaagaatcgaaagctcctggctaggaataatgtttctaagtggaatcaccgggttatgcgagaagcacatcatgggnntccactggnccncngttannnggaangaaaannancncnaangnncaagggannnntcccccatnt

SEQ ID NO: 5778 - DNA, 307 bp, Zea mays
  misc_feature: Incyte ID No: 700350667H1
  unsure 5, 87, 254-255, 285, 303: a, t, c, g, or other
tagangcaaacaggagagcaatgaagatgacaaagatgccactgaagatgaaatctcatgcagaagttatgaacagaagagcaaggnagataactcatgcaacattgaagatagtagcaaaacatatgagcagaatagtggagaagatgacactagtagtcctagtaaatggaagtgaaaagtaccagtgtatgaatattaaagatgaagatagcagccccggaggcgaggacacatgcataaatatgagtcannggtaaaaagagatgaaattatgttcttggngctgagagcttagaaaanatgt

SEQ ID NO: 5779 - DNA, 302 bp, Zea mays
  misc_feature: Incyte ID No: 700350669H1
  unsure 93, 268, 277, 296: a, t, c, g, or other
gtagctagtaaaccacaagcagaactgatgatgaacaatcttgtgcttgaagtgcttttggcaaatctccatgtgactcaatcctctagagtnaaggaaatctgtcttggaatcctgggaaacctagcctgtcatgaatctctagtaaatgttatcagcctgcacaatggtttgactgctacggttatggatgcagctatttctagacgactctgcttgccttctgaagtattcaggtttttggctgctgttttacgtaccagtgtgnctgtttcangggctgagctcttttactnagaatt

SEQ ID NO: 5780 - DNA, 301 bp, Zea mays
  misc_feature: Incyte ID No: 700350673H1
  unsure 21, 295, 298, 300: a, t, c, g, or other
tttatttacatcctgctgaangttcgcctgcgccaaacataactcaagggaagcttagtgctccacggatattacgaattcacaaggttgctaactatgtggttgagaaactcgttcttgacaaaccattggatggaggctctgatagtacgtttgttatgggattgagttctgctcaatcacagctctcacagctagatagttcttcgcggctggactaaagccatggcaaaaaacaaagccatgtattgaggtatgtgctataaccagttctatcaccagatatgagtttggnaanant

SEQ ID NO: 5781 - DNA, 309 bp, Zea mays
  misc_feature: Incyte ID No: 700350675H1
  unsure 3, 6, 12, 18, 26, 37, 49, 52, 68, 76, 82, 88, 98, 124, 153-154, 168, 187,: a, t, c, g, or other
tcnccntctcgnctccangagccttnacaaattgccntctcagatcttntcntaatcttactgcaagncctagccnaatgcncagacncatcccagcnctagcgacaccaaccagctcgccagngaccatggggaacccggagaagtgatganncagatcttcgttcntcaagttcacctcgaagtngntgnagcggnangngngcnagtgcgagaaggaggagaaggagcagaagctacaaggtncaagaaggcgatcganaagggcaactggacggcgcccgcatctacgccgagaagcnatcngca

SEQ ID NO: 5782 - DNA, 296 bp, Zea mays
  misc_feature: Incyte ID No: 700350677H1
  unsure 35, 87: a, t, c, g, or other
tgaaacaagtgatgttgtagattgggaatcagttntaaacgctccattttctgaggttgcaaaatgcattgcaatcaggggacagcncaacattttggctgtgcggatactggcttttctcgaccatgtaaagaaagctcaagatggaagctttgacctagattggcttagatttgtatcacgtgaaaaagccaaaaaatttctgctagtatacatgggattggagtgaaaagtgctgactgcattgcctttgtcatgaggcatagagcattccattgagtcatgtagctcgcata

SEQ ID NO: 5783 - DNA, 305 bp, Zea mays
  misc_feature: Incyte ID No: 700350678H1
  unsure 44, 105-106, 113, 256, 260, 288, 294: a, t, c, g, or other
tcccccgtaccaaacaaacctcaccgagtcgcaactcgcaaggncagtgaaaacgcccaaacgagcgcgggcacgccaaccaaagcggcgaaggcgaaggaaggnnggaaggnagcaagcaaagcagcagccatggggcttgactactacaagatcctgggcgtcgacaagggcgccaccgacgacgacctcaagaaggctaccgcaagctcgccatgaagtggcaccccgacaagaaccccaataacaagaaggnggcngagaacaattcaagcagatctcggaggnttacgntgtcctcagcg

SEQ ID NO: 5784 - DNA, 302 bp, Zea mays
  misc_feature: Incyte ID No: 700350680H1
  unsure 5, 23-24, 26, 127, 154, 156, 161, 191, 213, 252-253, 277: a, t, c, g, or other
tagcnatccgctcccctgtccgnntnggcgcccaagaggctcagggcgatggcctcagacgccgccgcagtgccgaatcccccagcctctagtggctgccccgcgatgaaggcggagttcgcaaagnacgcggagtacctaaacaccctgaatnanaaganaaaactgttaaaaaagctagtggggatatnacaatgaacagaaaaaaggtcnttttcaggtccacagaatcacgaaagttaacagggacgnnttctctcgaagggagaaaatgatnttgctgcattgttaatcaatacatg

SEQ ID NO: 5785 - DNA, 176 bp, Zea mays
  misc_feature: Incyte ID No: 700350681H1
  unsure 2, 7-8, 16, 19, 41, 106, 147, 152: a, t, c, g, or other
gncgtanntcgtcggnaanatcgtcgagattttggaaatgnaccctgaggatgaggctgaagaagatggtgctaacatcgatctggactcacaaaggaaaggaaancgtgttgttctgaagacatccaccagacaaaccatattccngcgtnaattgggttagttgaccccgataa

SEQ ID NO: 5786 - DNA, 212 bp, Zea mays
  misc_feature: Incyte ID No: 700350682H1
  unsure 41, 69, 101-102, 192: a, t, c, g, or other
tccacctcgaccagtctcgatcccgtggactcccgattgcntccttcagcaacttccatacccccagcncggcggtgcggagcgagcagagcagccggagnncctgtcggatccgccgccgtcaagatgaatgacgccgatgtatccaagcagatccagcagatggtgcggttcatccgccaagaggccgangagaaggccaacgagatctc

SEQ ID NO: 5787 - DNA, 295 bp, Zea mays
  misc_feature: Incyte ID No: 700350683H1
  unsure 12, 66: a, t, c, g, or other
taaaaaagaganaaaaagcgactatcaaagcgtcgagcaaaggataaagcacgcaaagcaacaggnatgcaggttgatgctacaggagatgattatggcgatcctgacctgttttctattagtgttattaagggtggaaaagaacttgaagctgttgaatcagcagagattgatgtggaagatgaaattggacacggtgataatgaggatactcaagctttgaagactctgatgaggaatggatctgacgaggaacagcagaggtatgatgcccacttgaagagagctgatgaac

SEQ ID NO: 5788 - DNA, 294 bp, Zea mays
  misc_feature: Incyte ID No: 700350684H1
  unsure 194, 204, 231, 280: a, t, c, g, or other
tgaaatacaaactgtaaatatcaagacagtcggtgcaggttttgaagccacagatggagaaagattacccttggctgtaaaagagttaggaagctgtgatttgtacccacagagcttgaagcataaccctaatggacggttcgttgttgtatgtggagatggcgagtacataatttatactgccctggcctggnggatagatcnttgggtctgcacggaattgtttggtcnccagaaggagaatatgcattagggaaagtacctcaagattaagatttcnataaatcgttccgg

SEQ ID NO: 5789 - DNA, 302 bp, Zea mays
  misc_feature: Incyte ID No: 700350686H1
  unsure 133, 143, 171, 173, 195, 253, 278, 286, 296: a, t, c, g, or other
atccccctttctttcctcgtggtgacgactgggctagtgctatcgtccttccgccaggtcttcgccggcgacgagcacctaccaggtgaccctattccttttcttcactcggtgtataatccccctttgctgncaatcaagcncctcaaacataataagcaaatagtctcntncacgtgattgccaaaattagtncaagacgggtgctcttgctgcgtggccgctaggcacatgggacgaagtctgaccctgnaagcagagatcgttctatggatccnactgagcntcgttggcgnaaaaac

SEQ ID NO: 5790 - DNA, 127 bp, Zea mays
  misc_feature: Incyte ID No: 700350687H1
  unsure 103, 109, 113, 123, 125: a, t, c, g, or other
ctttttcctgttggtatgtgatatttttcatttaatatgactatctgctggtgttggggccaatagatttgtgaatattctgtggatgtgtctatgtataggngtgtanatanatatatatananat

SEQ ID NO: 5791 - DNA, 288 bp, Zea mays
  misc_feature: Incyte ID No: 700350689H1
  unsure 24, 35, 37, 63, 65, 70, 76, 90, 103, 163, 173, 175, 185, 196-198, 206, 210,: a, t, c, g, or other
ggcgccccgagccctcctcctgcngctctcgggangnctggccctgaccgagactgggcctgntncccantccatnaggtatttcgacancgccgtgtcccgncccggccgcggagagccagcttcatctcagtgggctacgtggacgacacgcagttcgtgnggttcgacancnacgccgcgantccgagaaggnnnccgcgggngccntgngtggancaggaggnncgcaatantgggacgggagaanagantacagcnccagcacagctgacanatgagcntnga

SEQ ID NO: 5792 - DNA, 278 bp, Zea mays
  misc_feature: Incyte ID No: 700350690H1
  unsure 14, 17, 22-23, 55, 85, 151, 159, 181, 185, 202, 212, 229, 240, 245, 251,: a, t, c, g, or other
tgccaaggacagancanccggnncccggccctaaaactgccgtgcagcgggaganaagcgagggaaagatggaccggtaccaganagtggagaagcagagggaggaggcacccatcaaggaaaacgagatccgcttaccacgcggggaggntgcgcaantaaattcacttacgccaccggnttgntcaggacaaaggttctnatgagttgtnttaaggcctggggaggntatcaataagntctcnggttgnaanttnacacaaggngttttncgcccc

SEQ ID NO: 5793 - DNA, 289 bp, Zea mays
  misc_feature: Incyte ID No: 700350691H1
  unsure 37, 77, 83, 119, 174, 182, 224, 250, 268, 277: a, t, c, g, or other
atacccgccgtcctccctgctcctgctgccgcgtgcncctctccggccacccgcagccggcgcagtgtccatgaacncgcacntctttcttcgcccggtacccattcagttcgtccgcntccttctcttcgagtttgggtgcccatggagaccagcagtgcgcccgctgccganaccgaggncggctggtagtgcttggaccgaaccaaggagggcgtcggacntacgcgcttgctgagcttcgagaaanttcgcaaacggttatttnaatggagancacatgctctgg

SEQ ID NO: 5794 - DNA, 58 bp, Zea mays
  misc_feature: Incyte ID No: 700350692H1
  unsure 4, 6, 19, 34, 48, 51: a, t, c, g, or other
ttgnangtttgttagattnatctgttgcagctgnatattaagacgganacnggggtta

SEQ ID NO: 5795 - DNA, 294 bp, Zea mays
  misc_feature: Incyte ID No: 700350693H1
  unsure 29, 256, 268, 290: a, t, c, g, or other
ctggtcggaggcccaagcgggttgccgtngccgctacgggcatggtcgcggacgtgattggcaaggagtacacgcgacccgcggctaattctgtagtaagcatgccaaatgcttggaagggtcgggacggggagagcgatggcagcgggtctggtggccgcaaggacagtgttgaagaggcagagcagttcctgtgctccatgctcggggataattccgagcttggcatgggtgttgtcagagactgctaggccantatgggtacganttgaaaaggctttggatgcatnttaa

SEQ ID NO: 5796 - DNA, 196 bp, Zea mays
  misc_feature: Incyte ID No: 700350694H1
gtcttacttgcttccgagagttgatatatcaagagattaaagggcaagttaaagatgcggtgatagctctgatagacaaagaatgcgagggtgaacagattgaccggggtctgttgaagaatgtattggatatttttgttgaaattgggctgggtcaaatggagtgttatgagaatgactttgaagatttcttgcc

SEQ ID NO: 5797 - DNA, 290 bp, Zea mays
  misc_feature: Incyte ID No: 700350695H1
  unsure 252, 288: a, t, c, g, or other
tccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatgggcatgatcttgagatcggtctgatgctcctgtgttttcaatgttgttgttgagatcacaangggaagccaattaattatgagttaaaaaaaaatggntg

SEQ ID NO: 5798 - DNA, 321 bp, Zea mays
  misc_feature: Incyte ID No: 700350701H1
  unsure 7, 16, 43, 70, 77-79, 219, 259: a, t, c, g, or other
gcaggcngtggccgangtcctcttcgcgctgccgcccaacgangaccgcgacggccccattatccacctncccgccnnnccaccttcagactcccgcgggagaagcatctacccaagcccaagccaccgaccaagtgggagctgtttgcaaaggcgaaaggaattaccaagcgcaaaaagaacaagcgtgagtgggatgagcaaactcaatcctggaancggactcatggctatgaccgtgttaatgatgacaaagacntccaatcatgaagccaattgactgatgagccggtgttgatccattgcgcaagaaggatgaga

SEQ ID NO: 5799 - DNA, 316 bp, Zea mays
  misc_feature: Incyte ID No: 700350702H1
  unsure 252: a, t, c, g, or other
agagaacgaaagaaggaaggtacaagggaaggaagttcagttcagtatgtcatttctttggatatcaggctcgaggatctacaccatcaaatttcgactgtgactatgcttatgctcttggacgtatctccctgcatatgattgcagttggattgactggctacatggcaactgtggctaatctgaaagaccctgttgacaaatggagatgtgctgctgctccttaactgcgatgatgagtgtgaagaggcnttacgtggccctggagcaatccctatagggaggcctccattcacccttctccaatgactgaaag

SEQ ID NO: 5800 - DNA, 314 bp, Zea mays
  misc_feature: Incyte ID No: 700350703H1
  unsure 283: a, t, c, g, or other
taagagtgatgtctatagctttggggttgttctgttggaagctattacaggtagagatccaattgattatgatcgccctacaaatgaggtaaacctggttgactggcttaaaatgatggttgccaacagacgttctgaacaagtggtggacccaaaccttgagagaaggcctcgacaaaggagctgaaacgtgccctttgactgctctgaggtgtatcgattgaagctgagaagaggcctagcaggaccaggtggtccggatgttggattctaacgaactccntacctcaagaggaaaggagacaccgaccatc

SEQ ID NO: 5801 - DNA, 320 bp, Zea mays
  misc_feature: Incyte ID No: 700350705H1
  unsure 2, 68, 124, 258, 294, 318: a, t, c, g, or other
gnaaattgtggtggggacgtcagcaatccagctgctgaggatctcatgagttgcgatattgactgcantggactgtcttccgatccagcaatgagcactcagtctcctgtggggttatgcctantgttggtgcacctgctggctcacagaattgccgtgatcaaccaaaaggcaagagcactctgtcacaagtggggcggtgtaccaaaacatggtacaatggagagcatttcatacagaggagtcaagccacactgnaccagcttaagtctccagatgccggccactagacanatactaagagaaatgtgtagtggncg

SEQ ID NO: 5802 - DNA, 320 bp, Zea mays
  misc_feature: Incyte ID No: 700350708H1
  unsure 174: a, t, c, g, or other
cttcatctcccaggttttcccctccaatcacccccaggtcttcctctcgcgagttgcggtctcgcggcccccttccaccgaccgccgcctcctcacaaccgcggaagctgcttccctctccattggacgcggccagcttccatctctcggtcacctccctctacatcccacggncgctaccaccttccctctacctcacacggccgccggcctctccaaggtctgcacacgcattcagcgacgcatttgcctatatcagcactgtggtcataactctagtagagaaaggagaagatgcaggcatctagggcaaggttttc

SEQ ID NO: 5803 - DNA, 312 bp, Zea mays
  misc_feature: Incyte ID No: 700350709H1
  unsure 259, 291: a, t, c, g, or other
agctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaatgacaaggttatggaggtggagcagaaatacatgagntcgcagacctgtctatctccaagagggtgacntatcaagaccatcccggattt

SEQ ID NO: 5804 - DNA, 315 bp, Zea mays
  misc_feature: Incyte ID No: 700350710H1
  unsure 2, 26, 72-73: a, t, c, g, or other
gnacaaccctgccttccttgccctgnggcagattgaagctgcaagggagatctcccacaccatttcggcctnnagccaacaaggtgttcctggactccaacgacctgctgctcaacctccagcagctgaatgtatcgagcaagcagaagaaatgatgtcacaacgttatcccatttcttctgagtttgcagtcagtagtggatgccttgtaccagacatgtgaggaacgctcggttttggatgtagtttcgccaatctcctgttatgtggaactgcgagtattgcttcaaaggcaagcaagctggacagttttgt

SEQ ID NO: 5805 - DNA, 318 bp, Zea mays
  misc_feature: Incyte ID No: 700350713H1
  unsure 102, 187: a, t, c, g, or other
attccctggcggtgggctgtggctggtaataaagctcgcgccacgggagccacgcacgcggacgccggcatattcgccaaacgcatcgcatcggcctcggcnaccggcgcggctgccctcctcctcttctccgtcgatccggagaggactttctctcgcctgctcgtcccttccgcccccgccggcnggccggtcctcttcccggcccactccgttccgatcgaccatggcggctaccgcccccaacggcaatcccactgtcagctccctcgcggcaaccgttccggttccaggcggttctgttcgacatggagggac

SEQ ID NO: 5806 - DNA, 320 bp, Zea mays
  misc_feature: Incyte ID No: 700350714H1
  unsure 145, 187, 316: a, t, c, g, or other
ataaacaagaaaaagaaaagaaaacccctgttgccagcgacagaagaagaaggggccccttctccttggttgcgttgcgcctccctcctgtcctgcgtgcgtgcaatcgacgcagaggcgcgggcgctcgcaccaccacaaccangacccgatggctttcatgcgctcccgctgcaaatgcatcttnctggcatgggagttgctcctaaacattagggagacattcgttgagcttcaaatgaagaaggcattccgatatgttatcttcaaaatcgaagagaagcaaaagcagtggttgtggagaagacagggctantatg

SEQ ID NO: 5807 - DNA, 310 bp, Zea mays
  misc_feature: Incyte ID No: 700350718H1
  unsure 2, 182, 265: a, t, c, g, or other
cnaaccgtcgccgccgtcgccgagagagttgtgactcccccagcggcggcctgcgaccacccgttccccagtcgtctcttctctccagaccgcatttgcgcccgtcccgtcccctcccctctccctcggcgaggtccgagagcagagctgcctcgggagggtcgtagtccagtccacccgtncgctgcggcggcggttacgaggcggggaattccggcgcgggttgccgcgatccccgcagtgatgtgcggatcgggtcagggtntgacccagccgggaatatggaggctgctggaggattaggccggga

SEQ ID NO: 5808 - DNA, 243 bp, Zea mays
  misc_feature: Incyte ID No: 700350719H1
  unsure 19, 30, 34, 36, 48, 59, 83, 125, 201, 203, 209, 224: a, t, c, g, or other
cgacctccgcccattccgntcgcggttgcntccncntccgcctccgcntccgcgcctanctcaatccagagccagggcagggnaaccaaaccctaggccctcgcgctcgtggtatccatgggctnaccgcgtcccggtggggagcccggatccagagctagggttccgtcctcggcggcaacgccatggagtgggacagcnantccganggcgccggcagcgtnggcgtcgacgagcaggaag

SEQ ID NO: 5809 - DNA, 310 bp, Zea mays
  misc_feature: Incyte ID No: 700350721H1
  unsure 130, 249: a, t, c, g, or other
atcccctcctcctcctccctgtccctggacgccggcgccggcgtcggctcctcatcgtccgcgggtaaggagactgaagtggtgaacgcggaagaaggttgtcattttgctaagttaaagttagatcatnggagcaatgccgccccataagatcgagacggggcaccaagatgtggtgcatgatgtcgccatggattactatggcaagcgcctagctacatcctcctctgataatacaataaagattcntggcgtaatggaaccttcacaccagcagcttgcaatttgagtggacaccaggcccagtatg

SEQ ID NO: 5810 - DNA, 303 bp, Zea mays
  misc_feature: Incyte ID No: 700350723H1
atgaaaaggagagtcctaaagttgatcctagaggtatattccatggccatgacagtactgttgaagatgttcagttctgcccttccagtgcgcaggagttttgtagtgtgggtgatgatgctgtctattctgtgggatgctcgaactggcactgacccagctgttaaggttgagaaagctccacagtggagatgttcatgtgttgatggaatcccctgatgttaactatatctaactggttctgccgataactctgtccgaatgtgggatcgtcgcaatctgggttcgggaggagcggttctc

SEQ ID NO: 5811 - DNA, 304 bp, Zea mays
  misc_feature: Incyte ID No: 700350724H1
  unsure 25: a, t, c, g, or other
gtcggttcacttctccaggtaaggnaagggttcgtactcatggcgccgccgcagccaaagtcgggccttttcgttggcatcaacaagggtcatgtcgtcaccaagcgcgagtgcctccccgcccgtgccaccgcaaggggaaatcaacgaagagggtgtctatggtcaggggcctgatcagagaggttgctgggtttgctccttatgagaagcgtatcactgagctctgaaggttggcaaggacaagcgtgccctgaagctgctaagagaaagcttggaatcacaagaggcaaagaagaagaga

SEQ ID NO: 5812 - DNA, 316 bp, Zea mays
  misc_feature: Incyte ID No: 700350726H1
  unsure 10, 27-28, 31-32, 39, 67, 76, 82, 85, 185-186, 188-190, 260: a, t, c, g, or other
acacactaancatataccaatgatgannggnntgtaacnccgagaaagcacataccaaggccaccanacacccacnagtctntgnaaggccttcgatacgggataatcctatttattacctcagaagtttttttcttcgcaggatttttctgagccttttaccactccagcctagcccctacccnncnnnttaggagggcactggcccccaacaggcatcaccccgctaaatcccctagaagtcccactcctaaacacanccgtattactcgacatcaggagtatcaatcacctgagctacaccatagtctaatag

SEQ ID NO: 5813 - DNA, 304 bp, Zea mays
  misc_feature: Incyte ID No: 700350727H1
  unsure 277: a, t, c, g, or other
ttgagaaccgtgtcttggataaacaaattattgactggaagcttaccttacatcaaataggccttgatgttctgcgcactgaccgcaccatggtattttatgagaacaaagataacatttcaaagttgtgggatattcttgctgtctatgcatggatcgacaaagaagttggttattgtcaaggaatgagtgatttatgttcacccatgatagtgctactccacaatgaagcagatgcatttggtgcttgagagatgatgcgtagactgcgaggtanttcagatgcacacaacatctgttgggg

SEQ ID NO: 5814 - DNA, 308 bp, Zea mays
  misc_feature: Incyte ID No: 700350728H1
  unsure 5, 13, 15, 18, 21, 24, 27, 32, 44-45, 52, 55, 57-58, 63, 67, 70, 76, 179,: a, t, c, g, or other
ttgcnctcggtcncntcnatntcnagngccanactaaccccttnnctttccncanannatatnattnttntccggnaacggggcttcgaggtggtatatatgaccgagccctttgacgagtactttgtgcagcagctcaaggaatttgatgggaagagcctggtctcagttaccaaggngggtctggagctgcctgatgatgaggaggagaagaagaagatggaaganagcaaggcaaagtttgagaacctctgcagctcatgnnagacatcttagataaganggttgagaaggtgacatctccaata

SEQ ID NO: 5815 - DNA, 311 bp, Zea mays
  misc_feature: Incyte ID No: 700350729H1
  unsure 200, 209, 213, 217, 233, 235: a, t, c, g, or other
caacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttatngtgaccgcncatntgtngacatgaatgctcatncnttcctgtttgatggccgcagtttcgcggcgagcagacccctgatgagctggagatggaggacggcgacgagatcga

SEQ ID NO: 5816 - DNA, 315 bp, Zea mays
  misc_feature: Incyte ID No: 700350730H1
  unsure 2: a, t, c, g, or other
gngcggtaggataaagtagcatagcataccacaaaaggtgctgcttgacagatggcaagcttcccacaccttcacgcagatggagcatggcctagccagtggtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagctctgctcgctccaaggattcaaattcaaaggaaagcagccaaag

SEQ ID NO: 5817 - DNA, 114 bp, Zea mays
  misc_feature: Incyte ID No: 700350731H1
  unsure 68, 73, 78-79, 85, 87, 89, 91, 107, 110-113: a, t, c, g, or other
ccgccacctccgtggctgtggctaccttcccggctgcccgggctccaatggtttccacacaacatatnattgngctcnncgccangnangnccgacactcaggcctngcnnnna

SEQ ID NO: 5818 - DNA, 131 bp, Zea mays
  misc_feature: Incyte ID No: 700350733H1
  unsure 28, 64, 70, 90, 129: a, t, c, g, or other
gattgaataagctgagtcagagcatacnagaattctcatgttgtacacttgtgttttatgaacngcatanacacttcacgacggtaaaanaagcctgtttttcggagcgacagaagctcctgcgatcanaa

SEQ ID NO: 5819 - DNA, 305 bp, Zea mays
  misc_feature: Incyte ID No: 700350734H1
  unsure 52-53, 300: a, t, c, g, or other
gcgagctcccagtctcccactccatccatggcgatcgccaccactacctctnncctcctcgctgaccattcgtctcctccacccgaaccccaacactaaccccgctcccagatctctccagctcctcagtagcaggaggtgcgctcgtgccgccgtagccggagggcggtgccttacggggctgctccccggcgtgggatttggtcgatcagggatgacttggtggtgccgaggtctccctactttccagtggatccgcggcggggcaagagcgtgggccgtcgcccatggtgatggagnggttc

SEQ ID NO: 5820 - DNA, 299 bp, Zea mays
  misc_feature: Incyte ID No: 700350735H1
  unsure 2, 24, 35, 38, 78, 103, 105, 107-108, 113-116, 123, 181, 194, 201, 256,: a, t, c, g, or other
gntggagtatatagttcgtggtgngcagaggaatntanttgagcttatgcatgctcgctgcaatcaaggcgggttganaggctttggacagggaactttgtcncnanncttcnnnncgcccantcaaggcagtcaacttctacgcatatgacagttacagaaagcaactgctcaaatggtntggtaacgaaganttctgcnaactttgagagatttattgctggtgctttgctggtgttacagcacgttatgtgcntacctatggatacaatcaggacaaagatggnagctctggnggt

SEQ ID NO: 5821 - DNA, 275 bp, Zea mays
  misc_feature: Incyte ID No: 700350736H1
  unsure 26, 44: a, t, c, g, or other
caatattattcattgttgaaatatantcagttgattcagttagncaagccttatacttgtggcctaacgtcacttgatattttactggagaggttggatatgtctgtaaggaggatgaaatattgttatattggattaaatagagtattggaggtccaagttttggagcttcttgatagctcattatgtagactctcaaagatgcagtttgtaccaaggtagttctgggtaaggtgcttgggtaataatcgcttagaggattgtgcgctgatggg

SEQ ID NO: 5822 - DNA, 303 bp, Zea mays
  misc_feature: Incyte ID No: 700350737H1
  unsure 16, 184, 188, 200, 238, 302: a, t, c, g, or other
tccgctcggccaccanctttgaccgcctcccctcccctcctctcctgtgttcctccataccccactaccccccgcaggagcggcgcggcggcggcaaaggcaaaggcaaaggcaagatgttcgggcgcgcgccgaagaagagcgacaacaccaagtactatgagatcctcggggtgcccaagtnggcntcccaggacganctcaagaaggcctaccgcaagccgctatcaagaaccancccgacaagggcggtgaccccgagaattcaaggagctcgcacaagcctatgaggttttgagtgnt

SEQ ID NO: 5823 - DNA, 303 bp, Zea mays
  misc_feature: Incyte ID No: 700350738H1
  unsure 31, 88-114, 155, 298: a, t, c, g, or other
accacctataataaattgcacgagatttgcngcgaggccgcatctccatcccgcatcgcgcattcgcatccaccggccactgccgagnnnnnnnnnnnnnnnnnnnnnnnnnnngagaagaggaagaagaggggaggcgcgacaaaaagggtgcngcgcccccgcatcgcccccgacgccggcatctctccctcgctctccttctcccgatctgatccgaagcgcggcgttcgacgacgacgacctaagggcagatggcatcgaccaacctgctgctggaggagcccatccggatggnctcca

SEQ ID NO: 5824 - DNA, 305 bp, Zea mays
  misc_feature: Incyte ID No: 700350739H1
gggaacaggaggaaaaaagagcgagaactcgcagctgacgcgcacacggcaagccccaattcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagtttcacggtgcagacggacctgggcgccacggtgggcgcgttcaagaggtcttatccggtcagctgcggctgccagcaccgcagcagcgcctgct

SEQ ID NO: 5825 - DNA, 302 bp, Zea mays
  misc_feature: Incyte ID No: 700350740H1
  unsure 2, 160: a, t, c, g, or other
gntgcacctcttttcatttcaccatctcctgcccccttaaaaaaaaaactcaccgtcgacacgccctcccgtcccgagagttctgaatcgaaaccgtcggccacgagagcagtgcgaaggcccaccgcgatggctcgaaccaagcaccaggccgtgaggnagacggcggagaagcccaagaagaagctccagttcgagcgctcaggtggtgcgagtacctcggcgacgcaggaaagggctgctgggaccgggggaagagcggcgtctggaggtgactcattaagaagacgaaaccacgccac

SEQ ID NO: 5826 - DNA, 302 bp, Zea mays
  misc_feature: Incyte ID No: 700350741H1
  unsure 2: a, t, c, g, or other
anaaaataacctggcagctgctgcaaaagattctgatggtgcattctttaaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgctacgaaatgtggaggccaagatactcacaaaacgagctgaactttccaaatttgagtcagagtatagggaggttttggcgaagttcactgaaatgaccagcc

SEQ ID NO: 5827 - DNA, 300 bp, Zea mays
  misc_feature: Incyte ID No: 700350743H1
  unsure 2: a, t, c, g, or other
gngacgatgtccgtgcatatggaacggataaggagcatactctgagggtaccagaagattccttctacaaacagatggctgctgaattcacaaaatatcagattgcagtggacatattttctttcagcgataagtactcagatatagcgtctttaggatctttggcgaagtatactggtggtcaggtgtaccactatgcatcattccagacacctacacatggtgacaaacttaaacttgagcttagtagggacctacacgagagactggcagggaatctgttagcgtatcagatgtgga

SEQ ID NO: 5828 - DNA, 288 bp, Zea mays
  misc_feature: Incyte ID No: 700350744H1
  unsure 256, 264: a, t, c, g, or other
cacgatcaactgggctgttaccgtcatcggctcacgaagaggaaaactaaggagaggtcattctgatttatcctgagtcgcatggggtattatagctaaccgattccgtaaagaaggctcttagaaacagcatgctctatgccatgcgagtggagagtgttatgtggaattgggggcatagaaacgctcgctccagttagaaatgtgtgtttgtgctaaatgtgatctactagttcctccatctccgtggtttcanttcctcantctgtacggacattagcttgagca

SEQ ID NO: 5829 - DNA, 305 bp, Zea mays
  misc_feature: Incyte ID No: 700350746H1
atttgctacaccaccacacccacaccccatcccagcacacaacaagcagcctggtttacggtagctgctagcaaaacaatggagaaccctgctccgagcatcgtagtggccatcgccgcacccgtggcggcggagttcgtgaagctcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacaggg

SEQ ID NO: 5830 - DNA, 305 bp, Zea mays
  misc_feature: Incyte ID No: 700350748H1
  unsure 2: a, t, c, g, or other
gnttcccgtacaatttttgccggtcctgtcttcggtaagacggattccgattccgttgttttcttgccaaatccttcgcagcttgggggcggtttcgctccggttcttgcgcttcggctccaggccatggagcagcggaggtggctcgcggtagccgttttgatgtgcctgctggtgctttgctccgggagagaactgaagaccaaacatgtgcccatatatgacccagtgctggcccggacacttgctgaatatacttctgctgtctatactgctgaccttacccaatgtttacaggacagtga

SEQ ID NO: 5831 - DNA, 131 bp, Zea mays
  misc_feature: Incyte ID No: 700350749H1
  unsure 72, 82: a, t, c, g, or other
tccgtcgtcatcctgctgtgccgggactacatcagctacatcttcaccgagggcgacgacgtgtcgcgggcngtcgcccagntcagcccgctgctggcggtcaccctcatcctcaacggcatccagcccgt

SEQ ID NO: 5832 - DNA, 195 bp, Zea mays
  misc_feature: Incyte ID No: 700350750H1
  unsure 194: a, t, c, g, or other
gtgaacttgtccgaagataccctgaagctatacttctctaggttgagcatcatgcaggtttgatgaagacattaaaaaacgccagttcaggtcatggaggattgaagcactatgacaggatttaaccatgatatcatatgtattatattataatgtgtaatcttaaaaaaactagtccaattatcatgtaaggnc

SEQ ID NO: 5833 - DNA, 284 bp, Zea mays
  misc_feature: Incyte ID No: 700350752H1
  unsure 248, 258, 280: a, t, c, g, or other
ggttcatggaacgatatgctcctactgcaaaagatcttgcttctcgtgatgttgtttcaagatcaatgacaatggaaattagagaaggacgtggtgtagggccattgaaggatcacatttatttgcatctgaaccatctgccgcctgaggttctcaaagaaaggctccctggtattctgaaactgctgctattttgctggtgttgacgtcacaaggagcccattccagtttgctatgtgcatacatangggtggtatnccaagaactaccaggggagtantgga

SEQ ID NO: 5834 - DNA, 275 bp, Zea mays
  misc_feature: Incyte ID No: 700350753H1
  unsure 207: a, t, c, g, or other
gtgattgagaggaagattgaatccctcgaggacatggccaccaaggtcagcaaccggagattcaagaagatggttgaacgaccgcttgctgattgagcttgtcccacgccttcatgttgaagaaatcaaaggcctctttgctcctccaccatggggtgaggagctgcccttgtcagcatctgcaggacaagtgttagtgactgggangccttcaggagcatcgacatggatgctgaggcaagattgatgcaacacatgaaacgatcatccgaaaa

SEQ ID NO: 5835 - DNA, 292 bp, Zea mays
  misc_feature: Incyte ID No: 700350754H1
gtgaaagattccaccggcatccccaatccccatggcctaccgccggaagcagggagtcgccgccgccgattcaccggagctcctatccccaggactccgcctcgtcccacggctacacgtcgttcaaaagcatagatgagcccaagctcgggctgtggcgaactctggctaccaaagccaaggggatcctcgacgaggacgggttggcgcataagttcgaagacttgaggaaagaacggctcgtagcgacgccaggcatccagcaaagatcaggctctaactctcgctggtc

SEQ ID NO: 5836 - DNA, 287 bp, Zea mays
  misc_feature: Incyte ID No: 700350755H1
  unsure 57: a, t, c, g, or other
tgaaaccaaatttaaagctgcaagtaataactagaaaaactgatttgacaccagtgnacgtttaaacttatcaaagggtgccacttaggcccttgaactttgtaagtgctttttgggtccctaaatgtgttttatggtgcactacacatccctaaacttgtaacatggtgcatcacagatctatttttttggaccataccgaccatgtggtacacacttaacaatttatggggcctagaaatgtgtttccaagtttatgggaccaagtggctcctcttaacgattta

SEQ ID NO: 5837 - DNA, 279 bp, Zea mays
  misc_feature: Incyte ID No: 700350757H1
  unsure 75: a, t, c, g, or other
atggctggcgagcccgcatttgcagacattgttcctgggcatttacgggacgccgccttcattcacatacaaganacagttgtacactgttcgtgatggtggaaccattgctttggattggctgctcgcatctgatttggaagttgcagatggattcattcgaaagatgcttcaacacccctgtagttgtggttcctggattaactagcgatctgctgctgcttatgtaaaacactggtttactccaggcaagcaaaggaggaatgttgttgtaagcaa

SEQ ID NO: 5838 - DNA, 275 bp, Zea mays
  misc_feature: Incyte ID No: 700350760H1
  unsure 60, 65: a, t, c, g, or other
gctgtgagccaagccagcccagctccggcgactggcagatgtttcagggtccccgtccgnttgcngcaggttccctgatatcggtggccagcagccgactttgtggttagtccattctcttccggcgggatacgttgcggaccacttcgctcagctgctcgcgacggcggcttgtaccctgatttgggtgtggttctgtagagcggtcgtgtcgtccgagcgttgatctgaaccagcgcatttatcaggactagcatgtagcagtgattggggag

SEQ ID NO: 5839 - DNA, 279 bp, Zea mays
  misc_feature: Incyte ID No: 700350761H1
  unsure 60, 63, 84, 169, 184, 187, 217, 229, 232, 238, 241-242, 250-251, 257, 277: a, t, c, g, or other
ggatcccaaaatctcaaaccgtcaaacgggacccgacacctgagatacgcgcatggcgtngcngcgccgcattccctctgtgcntgccagatccggcaacaaagagaatatatctcaagatggagatgctcccttggattttgcaaccttgcctaaagaagggcctgcnactacaaggcggaancanaagcttgcaggtttcacttgaggggacgcntgcctggaatcntgntttttngannggaagaanntgtttnggataactcggagtttctgngc

SEQ ID NO: 5840 - DNA, 278 bp, Zea mays
  misc_feature: Incyte ID No: 700350762H1
  unsure 275: a, t, c, g, or other
taacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgttcgaacacgccaagaattcattcaggtcgtcttcctgaaggtggacgtggagaatgaaggaatcaccgcggctacgangtc

SEQ ID NO: 5841 - DNA, 278 bp, Zea mays
  misc_feature: Incyte ID No: 700350763H1
  unsure 210, 214, 276: a, t, c, g, or other
tggtggatatggctataaccaaggcagatatgggaactatcaagaaaatggtggaatgctcagtcattcatccaccgtggagaagctctacgcatgggagaagaagctgtttcttgaggtcaagagttacgaggggtataagcaggagcatgataagaaggtcatctgttgaggaagcaagaggtgaagggtgtggattactgaagatgnagangaacaagatggagattgagagctggagtccagatgctggttgccaaccatccatcgagaccnca

SEQ ID NO: 5842 - DNA, 281 bp, Zea mays
  misc_feature: Incyte ID No: 700350765H1
  unsure 29, 50, 53, 66, 71, 88, 90-91, 196, 199, 268: a, t, c, g, or other
gcaagcaagttcctcaattacttcgttangcaaattgttccagcatttgngangcttcctgaaganaagancctggatttgctaaagnannttgcttcaagttcaccatatgctgcagcacaagattcacgtcagctgcttccatctgttgttcagttactcaagaagtatatgcctgggaagaaggtggaagatntcnaccataattatgttgagtgctgcatacactttcatcattggctcacagactccaacacacggacgtctngtggtacagatgt

SEQ ID NO: 5843 - DNA, 282 bp, Zea mays
  misc_feature: Incyte ID No: 700350766H1
  unsure 174, 243: a, t, c, g, or other
gctggctgaaccagtgggcttgttcacgttcatttggactcggtactcgaattccatgggatgagcagttccttgtagaatctctttctgattctaccctatacatggcttattatacagttgcacaccttttgcaaaatggtaatatgtatgggaaagaaatatcttcagtanggccagaagaaatgaccagtgaagtccggggattcgtgtttgtgatggcccggcaccaaaagcgagatncctgccgcccgttgacaagtgaacatgattaagtatggg

SEQ ID NO: 5844 - DNA, 288 bp, Zea mays
  misc_feature: Incyte ID No: 700350768H1
atggcaatgagagatgctggtgtctcacaacctgttccaattggggcactagccactgcgcttgctaacgcctcaccagatcagcaaagactgatgcttggtgagaacctgtatcctcttgttgaacagctggagcgtgagcaggctgccaaggtcactggcatgcttttggagatggaccagacggaggttctcacctgctggagtcgccagatgctctcaaggctaaggttgctgaagccaggaggttctccgctcagcccagcatctccagcagagcaatgctcc

SEQ ID NO: 5845 - DNA, 286 bp, Zea mays
  misc_feature: Incyte ID No: 700350770H1
  unsure 2: a, t, c, g, or other
tnatccggcagatccgtctgggcaacgccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggagaagtacggaatcgggtccaagacgcccggcccgggctccagcgactgagcggccaggtatgctctgcagcc

SEQ ID NO: 5846 - DNA, 286 bp, Zea mays
  misc_feature: Incyte ID No: 700350771H1
cacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagactacaagatctacatcttcaaggtctg

SEQ ID NO: 5847 - DNA, 278 bp, Zea mays
  misc_feature: Incyte ID No: 700350773H1
  unsure 24-25, 27, 116-118, 219, 221, 268: a, t, c, g, or other
tgtaatcatttgttaagtaataannangggggagaaggcagtatctcataaggttaaattatgtgtctgcctttacatttatgcacaatttatcttagatgttgtttacatttccnnncactgcatttcttacatcttcatacttttaaccaacctatcttcgaagaggaggaactaaaggatgaagattaagctgatctaatgtgttgcctgtttttnanatcctgaatgaatcaaaaatgagtgacccacatggcgcccacatccntgaactcaaa

SEQ ID NO: 5848 - DNA, 277 bp, Zea mays
  misc_feature: Incyte ID No: 700350775H1
  unsure 92, 97, 230, 271-272: a, t, c, g, or other
gtgcatcttcaccagcggcacgtctatgctatcggtggtgtctgcatcaagccggtgctcgtgcttgcgctatggatcctctactttctgtnccccntgatctcgctcccgctcctccacccgatccagatcataatccgcgcggacgccgtgcgcatgcagctgctcgggttcataatctgcctgttcgtgtccggtgccgggttctacttcaagagccacaggtgganggctgcccacatcatcgtcatcgccctggtccagagcacgnnaatgg

SEQ ID NO: 5849 - DNA, 275 bp, Zea mays
  misc_feature: Incyte ID No: 700350777H1
  unsure 130, 172, 271-273: a, t, c, g, or other
agcaaccgcttgcgtcagacgcacactgacggagagtgatcactgatttctggtcatggcaaccgtaactgaggaagttgctccggtcgtcaccgtctccgaggagccggcgccggaagcggcgaaggangtggtggagaagccggaggaggggaagaagcccgacgagganggtgacgagaggaagaaggccgaccccgccgccgagaaggagaagaaggcgaggaagccgcggaacagtaagcccaatccgccgggctgcaccaccgcnnntt

SEQ ID NO: 5850 - DNA, 274 bp, Zea mays
  misc_feature: Incyte ID No: 700350779H1
  unsure 9, 48, 251: a, t, c, g, or other
tttcaaganagtaatgtggcatgtaggtgacccaatgccccacgaggnatctgtggcatcagcagcggttggttctgcaatcaaagtaaaagctgctgccattgttgtgttcacattctcagggagagctgcgaggttagttgccaagtataggccaacaatgccaattttagcagttatcttcccacgtgaaggatccgatccatcaaagtggcgttctatggcacaacacaggcaagacatgtttcgcntgagaggctgtacccttgagggg

SEQ ID NO: 5851 - DNA, 272 bp, Zea mays
  misc_feature: Incyte ID No: 700350780H1
  unsure 21-22, 182, 197, 248, 254, 258: a, t, c, g, or other
gtcgtgggatccatgatcagnnacttaaacgtggggattctgagaacattaaggcttcaaatggtatgtttctgaaccatagtgacgttgacagctccaagccaccagtggttgaactacttggagagttcgtgctgcaagtagctcaagagaaagatctaccaagaaattgtatcagaatnctggagatgctacgntaagaattgttgaaaccttgaaaaggagaggtgttgaaaagagcagatgcntcagcntcanccaagccctatgtt

SEQ ID NO: 5852 - DNA, 278 bp, Zea mays
  misc_feature: Incyte ID No: 700350781H1
  unsure 197, 236, 241-242, 259, 266: a, t, c, g, or other
atttgttgcgattcagattcagaagagccacgtggaaaggacattcccctaaaaggtatggagcctattactagttgtggaccaccagatatttctcgtccattccaaggaacacccaaactgcaatcttctacaatggtctcgttcaagaaaagttgctgataacatttgttccctgagccatttgctgtggatgntagttggggacagagttgcactcttctacatcagtctantttcnnctgccgtagaatgaaangggggcnagttatactgat

SEQ ID NO: 5853 - DNA, 285 bp, Zea mays
  misc_feature: Incyte ID No: 700350784H1
  unsure 106, 272: a, t, c, g, or other
gcagagagtttgttccgtccaggcaaccaaaaagcgttgccccgccgcgcagaggaagaagagagcagaggaggatggctcgtacgaagcagaccgcccgcaagtnccacgggaggcaaggccccccgcaagctgcttcgccaccaaggcggcgaggaagtcggcgccgacgaccggcggcgtgaagaagccccacaggtacaggcccggaaccgtggcgctgcgcgagatccgcaattaccagaagagcaggagctgctgatccgcaagtngcccttccagcgc

SEQ ID NO: 5854 - DNA, 275 bp, Zea mays
  misc_feature: Incyte ID No: 700350786H1
  unsure 3, 45-46, 55, 82, 97: a, t, c, g, or other
aanaccctcgaggtacctccattcgcagtcggccgtgtcctcggnnccgcggganatggcggatcaggagaccgtagctgcngttgatgcacctacnccggttcttggggaaccgatggacctgatgactgccctgcagctcgtcatgaagaagtcaggtgctcatgatggcctgtgaagggtctcgtgaggctgccaaagccatcgagaagcagccgctcagctctgcgtgcttgccgaggatgcgaccagcctgattatgtcaagcggtgaag

SEQ ID NO: 5855 - DNA, 265 bp, Zea mays
  misc_feature: Incyte ID No: 700350787H1
  unsure 2, 31: a, t, c, g, or other
gngttctatagcgtgtattacaacacgaggngtgacgaccacagctcgctgtgtggcccggtgattgacgatgtccgggtatgggcattgaacgccgcggctgggttgaaggcaagtattgggctggttcttggcatgttggtgtcgttggcatggtgttgttctgaaatctgaatctctcggtgccagtggtctgggaagtatggatgtataactctctgttattggaggctactattttggtataagctgaagttgttgatga

SEQ ID NO: 5856 - DNA, 273 bp, Zea mays
  misc_feature: Incyte ID No: 700350789H1
  unsure 155: a, t, c, g, or other
tcgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagtnggcgaaggcaaccgaaccatcgcctgagccactggcggcggcttctgcgccacgcccgcgcccgctgcgctcctgttttaagctacgtcactcttgggtcgttcagtgggagcaggac

SEQ ID NO: 5857 - DNA, 273 bp, Zea mays
  misc_feature: Incyte ID No: 700350790H1
  unsure 105, 155-156: a, t, c, g, or other
gtgggtcctcactcctccccctctctctctatcatcacccttcttccgccggaaggaaaagagaaaaacacacactctctttccgagctctctcgctgtctctcnccccagccgccaccatgtacaggcctctacaaccagggcttctcccctgnnagaaccctctccccccagattaggagcaaccccgacgctgatagccagtacttggccgagcttctcgccgagcaccagaagttggggccatcatgcaggtgtgccgatatgcagcgg

SEQ ID NO: 5858 - DNA, 271 bp, Zea mays
  misc_feature: Incyte ID No: 700350791H1
  unsure 263: a, t, c, g, or other
ttgggtcaggctgcacaatttatcttctctggggcaagcatgctttgcaagaacgataactgcagcaagcaagcacacgagaactcaatccactgtaagttgcatagcagcggcgttaacaaggcctgcatggcacggggctgtacaagaggtgcgcatggaggcacacctttgtgcattgggcacggaggtggaaggcggtgtgtggtccctggatgcccaaatgcagcatgtggccaaggccgtagcgaccgctgcgtgangcaggtgg

SEQ ID NO: 5859 - DNA, 265 bp, Zea mays
  misc_feature: Incyte ID No: 700350793H1
  unsure 249: a, t, c, g, or other
tgcagacggttgctgttggagttatcaagagtgtggagaagaaggacccgaccggcgccaaggtgaccaaggcggctgccaagaagaaatgatgcgatcctggcgcctgctttagcaatacctagttttcatgcatcacaagttttgtttgtgatcgttgctgttatcgtgtgaactgttgagatctgttagcagtgcactttatctattattggtaccatcttgctattcacctttccaatacaagangctctaagacctatag

SEQ ID NO: 5860 - DNA, 267 bp, Zea mays
  misc_feature: Incyte ID No: 700350794H1
  unsure 96, 98, 263-264: a, t, c, g, or other
ggggttgcttgagaattttggtgtttcagtttctacttggacttttcttttgtctaacaatacatgtgctattagtattgctcgtgatctggttcntnccatgagcttactaagcatataggtgttgatgcctattacacgtgtgcacagatttagtatgatacgattgacctcgttgtatgtttatagagcttagttggctgatttctcacaaggcgcagaccagggctcagcataggttttatatcctaaactcaagtgtnngag

SEQ ID NO: 5861 - DNA, 276 bp, Zea mays
  misc_feature: Incyte ID No: 700350796H1
  unsure 2, 221, 243, 255, 259-260, 263, 267: a, t, c, g, or other
gngcattactattttttcagggtttagcatcaattcttagctttcttcctgaaaccatttcccatcttctactatttgaagaactagaggcatagatgtattaatgtggcctttatttttcttgtgagaataagaaggataatacacctcccatgctggaaactaccttagaaacttaggtgaagagacaggtgtcagatatattatgtgacttgcccaanattgcctggcccgtggagaganagccttccatgnggcnnggnatgngggcctcct

SEQ ID NO: 5862 - DNA, 328 bp, Zea mays
  misc_feature: Incyte ID No: 700350801H1
  unsure 4, 278: a, t, c, g, or other
agcncctcctcccccgagtctcaccgccagcgcccatggcgacacgctactggatcgtgtctctgcccgtgcagtcacctggcgccatcgcaagctccctgtggtctcgcctccaggactccatctcccgccactccttcgacactccgctctaccgcttcaacgtcccggatctccgcgtcggcaccctcgactcgcttctcgccctcagcgacgacctcgtcaagtccaatgttttcgtggagggcgtgtcacacaagatccggaggcagatcgangacttcgagcgcgccggaagggtcgagagtgggacctcaccgtcgatggc

SEQ ID NO: 5863 - DNA, 312 bp, Zea mays
  misc_feature: Incyte ID No: 700350808H1
aaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcggaagacctactacctggtcagcctcgttgacaacgactacgtccagggggacctgtttgctgccttcaagatctgattatgctctcatggtctgtatgttgtatggttgg

SEQ ID NO: 5864 - DNA, 313 bp, Zea mays
  misc_feature: Incyte ID No: 700350809H1
  unsure 27, 81, 192, 293, 302-303, 307: a, t, c, g, or other
ggtggagatacttggccatactgatanagccatacaagttcagcttctaaggaaggtcgatggttataagatggtatttangtcatacagagcagagggttctgtgatgacaataaggaacgatgagtaccccaagttctctcaccagattccttgctttcgtctcacacatgaaaaaggtggcaagcttcncaggctatttggagcttgaccccttatcagtaccagaggaatttctcgactgattccatctgagataaactttatcaaccacaaatctggaaccttcttgngatgaagtnnctgnaactga

SEQ ID NO: 5865 - DNA, 311 bp, Zea mays
  misc_feature: Incyte ID No: 700350812H1
cgtaaatagtcacatgtcaaatatattagcagcattccttttgttgtacaattagggtaaatgccacagatattttaatagctttcttatcataaaaaactgcatggattcatacaacgtgaatatcaacgcggcgttagtgcatggaacttcgatatcgaggatctcaaggctcaagcatcattaattcatgatgacgagcctcctgaaataaaagaagacgaggacattgcaagaaacattgaggttgaaaaggacttgtcttcacggaaccattgggaaagtcatttgcaaatgagtgcaattccagg

SEQ ID NO: 5866 - DNA, 311 bp, Zea mays
  misc_feature: Incyte ID No: 700350814H1
  unsure 52, 73, 112, 117, 191: a, t, c, g, or other
gctgaggataaagtttcggtggagggatagactttggattggggacccggcngatgtcgtttcttgatgatgnccatttattgacggaggcttctaatggcttttgaccttnttgtncataggcttgtggtattcttttgaccccatatctcatttcttgcacccatccattttgcagcattttcaaattnagcaaaatctcaacctgcagtggagttgcaagttgcacatagttatcatcgcataggcatgcatggcagggtgtatttcttgttgataaccggggaatgagaagacagcgatagtgaaat

SEQ ID NO: 5867 - DNA, 314 bp, Zea mays
  misc_feature: Incyte ID No: 700350815H1
atcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattc

SEQ ID NO: 5868 - DNA, 318 bp, Zea mays
  misc_feature: Incyte ID No: 700350817H1
  unsure 50: a, t, c, g, or other
cttgcaatcacaacgaacaaaagctctcgatctcaccgacaccgaggaanaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaatgaaggaagtcaccgcggctacgaggtcgaggcgatgccgaccttccattcg

SEQ ID NO: 5869 - DNA, 314 bp, Zea mays
  misc_feature: Incyte ID No: 700350818H1
gcactgcaagcggaaatggcattgtgatcaggttctcatggagaggtgaaacatgtaaatgaagatgaaagctgagtcatctatactatatttgctatgcgtgtacaaacttggccggatatttggcaaccgcagcagagaaaagaggctgctccagcccagtgcttgtttcagtgactttggaatctgttgtcgatcgatgacagttcttctgttaatgtcgctcggttagctctacgctaattattcagatcacccaacgtgcatgtttcagtgttttgcttaattggcccatattgtctggagccgtgcat

SEQ ID NO: 5870 - DNA, 312 bp, Zea mays
  misc_feature: Incyte ID No: 700350819H1
  unsure 150, 161, 170, 306: a, t, c, g, or other
gacctatcttatttcagtagatgaatgatggcgacaaaagccatccatccatatggcgaaccggatggtgattcgatagtttagccgacacatcggaaacatttcactcgtccttcataaataactacatggtactaaagactgactttncacatgctgancacaacagnatgaaatcgctagacttctgtaacatgtagttatttatgaaggacgagtgaaatgtttccgaagtctagcgatttcatctgttgtgctcagcatgtgaaagtcagtctttagtactccctccattttttatattgncgcgtt

SEQ ID NO: 5871 - DNA, 312 bp, Zea mays
  misc_feature: Incyte ID No: 700350821H1
  unsure 50-51, 86, 101, 115, 141, 144: a, t, c, g, or other
ggcattgccgtggcagcggcaaccgtgtcgccgaagggacgctgccgtcnncgtcggcgaggaggctcgtcgacgcgttctggcanaacatgggcagcggnggtctgcttgacgnggacgcggcggcggcgcgccggagcncangtcctgtggagcggcgcctccacgaaggtgtccaagaggtcgagaagtaagagcaagatcttggagggtgatggtaagggaagtcggcgcaacggccatgctcggtggctttcagcagatctgatgagtaacgacagtgcaatggaggttggtacattctctcaagac

SEQ ID NO: 5872 - DNA, 308 bp, Zea mays
  misc_feature: Incyte ID No: 700350822H1
cgctaaggaaaggaggatcttttttcttagaacaaagcataagacattgctgagctatatgaaagacatggagatcgaacctgatgtaacctgttacacagtattgattgatggacagtgcaaagcagaatatctagatgaagcacgtgaattgtttgatgagatgttagcgaaaggacttacccctgatgtttacgtgtacacagctcttataaatggactactgtagccagggagaaatagctaaggctgaagatctttacaagaaatgacagataaggggatgaagccagatgtactgacctttt

SEQ ID NO: 5873 - DNA, 306 bp, Zea mays
  misc_feature: Incyte ID No: 700350823H1
  unsure 31-32, 305: a, t, c, g, or other
gggattcctcttaatggaaaccagtgtgganntgctgagtcagttgatgtaggtggtcagccaaatgctttgaaccttgcacttcaaaaacctgaatttgcactggtcactactgattctgggattgtattgctgcacaactcaaaagtcatttctacaaccaaagttaactataccatcacttcatcttcggtgtctcctgatgggacagaagctgttgtgggtgctcaagatgggaaactgagaatctattccatcagtggtgatacacttacagaagaagctctgttgagaagcaccggggng

SEQ ID NO: 5874 - DNA, 305 bp, Zea mays
  misc_feature: Incyte ID No: 700350827H1
  unsure 111: a, t, c, g, or other
aaatgcatgaacccgaattacacagagtttaagttcccacaaatcaaagctcacccatggcacaaggtattcaacaaaaggatgccgccagaagctgttgatctggtctcnccggctactccagtactccccaaatctgagatgcactgctgtggaggcgcttgtccacccattctttgacgagcttcgagatcctaatactcgtcttccaaatggccgcttcctgccaccccttttcaacttcaagcctcacgaattgaaaggagtcccagcagacattgttgcgaaattggttccagaacatg

SEQ ID NO: 5875 - DNA, 305 bp, Zea mays
  misc_feature: Incyte ID No: 700350828H1
  unsure 33, 35, 68, 73, 107, 115-152, 186, 235, 258, 269, 289, 299: a, t, c, g, or other
cttctcttctcgtggatccccaaatcctctccngncaccggcatcgctcctctcccgcccgccgacgnccgancgctcctatccacgccaccgcgtcggtgctcganttgcctcnnnnnnnnnnnnnnnnnnnnnnnnnnnnnnnnnnnnnnggaacggcgctcacgctgttccgattcgaacganctcgcccggcgatttttttccctggaacgggctggctccgaatctcggngaagtgtggggagcggctccacnctccaaccaancaccgcagatcaaccaaaangcgggcgcgngggcgg

SEQ ID NO: 5876 - DNA, 301 bp, Zea mays
  misc_feature: Incyte ID No: 700350829H1
ggctcagtatatgacaaaaaacaaagggtttttcctggcggcaccaacagagattgccattcaaagaaagcagcttaaggaaatcatcttctcacttctacctgcatgcacagaacctgatttggatactggaacacctttcagagctcaggcaataatcgcgaatcctcctgcttatggtcatctacacatagcagaagcacttggagcacctctgcatatcttcttcacttttccatggacgccaactaatgaattcccacatccatggcagaatgcctcaaagtgcaattataggcta

SEQ ID NO: 5877 - DNA, 306 bp, Zea mays
  misc_feature: Incyte ID No: 700350831H1
  unsure 167, 182: a, t, c, g, or other
atccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcantcgcagctacatcantggctaccaagcttccaaggatgacttggctgtctacacttcgttttcggctgctccctcgtccaagtatatcaacgtagcaaggtggtttaaccacattgatgcgctcgtgaggctgagcgga

SEQ ID NO: 5878 - DNA, 308 bp, Zea mays
  misc_feature: Incyte ID No: 700350834H1
  unsure 79: a, t, c, g, or other
cccaattgaatcatcctgtacactctcattttcggaacctcaacgggctcgagagttatttccttgcaatccccacgtncaaccttgtcatcttcatcaaatgtcagttttaattcaaagaatgagccgtccatgctaaccagtcagttctactggtcagcaaggcatacaagagctgactcctgcgctgctagcaccaacacagtcgtaattgaaaagaagcaagagccaagttctggtggttgtagatgtttggaataatatatgctcagctgaggaagaagtattacctgaggttactgctccag

SEQ ID NO: 5879 - DNA, 307 bp, Zea mays
  misc_feature: Incyte ID No: 700350835H1
gtctgtctctagatgatacaccaaaactcagtaacagtgatgatgcggttctggcagacaatgtcacaacggaccctgatgaaacatccttataccttcgtacaaaaccaacagattcagaaactgaaagtagctctgacgcaggagatgttgaaactgaatatctagatcaaaagctactttctagatgtctgcctgatttaatggatgttgactcgcccaaccacttactgaaaacaccagtgagaacaaaacatgtgactcttgtgcttgatttggacgagactcttgtacattcaacattgga

SEQ ID NO: 5880 - DNA, 218 bp, Zea mays
  misc_feature: Incyte ID No: 700350837H1
  unsure 17, 33-34, 59, 64, 68, 81, 90-91, 96, 114, 123, 135, 158, 163, 168,: a, t, c, g, or other
cgcgccgacgccgagtnctttctccatcctgtnnctggcgctgtttccgacaggatgtntctcncgangacggagtacgancgtggggtnnacacnttctctccggaggggcgnctgttccangtcgagtacgcnatcgaggccatcaagttgagatncatgngatcngtttnnanacaaaggatngtgttgnnctcgccgttgaganacgcgtgcnc

SEQ ID NO: 5881 - DNA, 298 bp, Zea mays
  misc_feature: Incyte ID No: 700350840H1
  unsure 58, 109-154, 263: a, t, c, g, or other
ggagaattcctcccttgccccgccgtcgcatcctcttcgaagttcgaatcgaatcgcnccgcgatcacccacctcatggcggacaaggagcctgtcgtggagcggccannnnnnnnnnnnnnnnnnnnnnnnnnnnnnnnnnnnnnnnnnnnnngggaggaggaggacacgggcgcccaggtggctcccatcgtgcggcttgaggaggtagccgtcaccaccggcgaggaggacgaggacgtctgctcgacatgaaggcgaantgtaccgattcgacaaagacggtaaccaatggaag

SEQ ID NO: 5882 - DNA, 298 bp, Zea mays
  misc_feature: Incyte ID No: 700350842H1
  unsure 35, 266, 293: a, t, c, g, or other
gtgccggacaccgtcgtgttcgatgatttcgagangttcgcacccacggcggccacagtgagctcgtcgctgctgcttgggatcactgggctcccagacactaagttcaagagtgcgatagatactgcactggcagatggtgagtgcaacgcactggagaaggctgaggacaggatgtcctgtacccctcaccaagggctcttgcaaatgttggcgctgaactggctcatcaagtccctgggagagtttcgacggaaatagatgcncggttaagttatgacacccagggcatnatcca

SEQ ID NO: 5883 - DNA, 121 bp, Zea mays
  misc_feature: Incyte ID No: 700350843H1
  unsure 100, 104, 106, 110, 113, 115-120: a, t, c, g, or other
cactggtgagctctgcagtctgcactctgcttagctccgagcttcagtgccttcgttgttagctgttagctccacagtccacagttccacacaacatacnaccngncaanatngnnnnnng

SEQ ID NO: 5884 - DNA, 301 bp, Zea mays
  misc_feature: Incyte ID No: 700350844H1
  unsure 25, 29, 32, 81, 113, 115, 120, 126-127, 131, 134, 150-151, 156-157, 162,: a, t, c, g, or other
ctcggggagacagtctgctccctcnagtncgncgaccgagtgggtcaagtggagctggggccagcccggcgccgcagggtncccgcgctcctccgggagcgccttcttccctnancaccnacactnngctngcncgcgaccccctgcacnnctacnncgtcncntggcagtcctccatgccccagtcgcgacaacggcncgggctcnagtttcgcgngccgcanangncctgcnnntctagtnctnggtcgcggcnctgcgcanngggtatcaggnnaggtntctgctggnagaggnggta

SEQ ID NO: 5885 - DNA, 176 bp, Zea mays
  misc_feature: Incyte ID No: 700350845H1
  unsure 2, 4, 19, 42, 48, 84, 87, 93, 102, 122, 130, 135, 150, 159, 161, 164, 167,: a, t, c, g, or other
cncnccccgaccgacctancctaatcggcgatggcgacggtngcgatngacatctcgaagcccactccagtggcgtccggcgangangccgcngcggcggcnaagggggaggagcggcgganggggcgangggcngcggcagtactaccngcagcacancnacnacntgnaannnc

SEQ ID NO: 5886 - DNA, 298 bp, Zea mays
  misc_feature: Incyte ID No: 700350846H1
tgcatgtataaagtatggtcagtttgacagtgcaaaagaaacttttgaggttattacagatcacgagagcatgctggatctatttatttgtcacctgaacccaagtgcattgcgacgccttgcacaaaagttagaggaatctgctacagattctgagctgaggcgataccttgagagaatattaagagttcgttcgactggatggacacagggtgtattcgccaattttgctgctgaaagtatggttcctaaaggccctgaatgggcaggaggaaactgggagatcaaaacacctacc

SEQ ID NO: 5887 - DNA, 293 bp, Zea mays
  misc_feature: Incyte ID No: 700350847H1
  unsure 10, 25, 66, 121-122, 226, 243, 254: a, t, c, g, or other
acagctcgcnccgttcctgcaagtncgcacccatcgtcccgcctacgcactgccgcccaacgatcnacgagctgccatggctaactcagcggcaccgggaggaatgaggtcgttcctgcannccgtgtctacggtcaccgaggaggcgccgacgccactccgcgtcgtccagatggagggcctggctgtactgaagatcatcaagcatgtgaggagtttgcgccantttagttacaagtcaantgcttgggttngatgttggtaatgttctggaatgaccaatgtttccgttc

SEQ ID NO: 5888 - DNA, 285 bp, Zea mays
  misc_feature: Incyte ID No: 700350848H1
  unsure 13, 28, 42, 46, 50, 74, 84, 87, 92, 94, 125, 128, 136, 151, 163, 167, 174,: a, t, c, g, or other
gtccgcctcaacngtccaaccctccggntcgacgtaagcgcnggcnacgngatgaaggtctccgtgaagacgcncaagggatcnagnttccntntcgaagtggatcctaccgacaaggtgccgangtnaaaaaggntatagagagtatacnagagcaggattntatncggtganccanaagtgttatncccaggggaggnctcaagacganacggatggagganaccagtagtgnantaatgntctgtangatgncngcagannatgggtcttcagngcagacng

SEQ ID NO: 5889 - DNA, 112 bp, Zea mays
  misc_feature: Incyte ID No: 700350849H1
  unsure 32, 42-43, 95: a, t, c, g, or other
cttatctgatgccaaagctcacatatacaganggacacttgnnaaatcatttaacactgaattagcttcagtccctagcaaagcagcatttctcnaaactctttgcgaaaag

SEQ ID NO: 5890 - DNA, 304 bp, Zea mays
  misc_feature: Incyte ID No: 700350853H1
tcgcatctgtttcgttccacccgccccgcgagaagcttctagaagggggagacccgccggagccatgccggaggaggagtcgacgtcgatcccgctcagccaggcggcggaggcctcgaccccgaggacccagccaagtcgccgccgcgacccagctcgcccaccacctccacacgcaaggcatgctgtgctgttcttcaaagttgggtctcaagaaaatttatgactggatgtgtagtccttttccctgttgcagtcacgttcttcatcacatggtggtttattcaatttgttgatgggtttt

SEQ ID NO: 5891 - DNA, 302 bp, Zea mays
  misc_feature: Incyte ID No: 700350854H1
tttttcaaaaagcagcttgtctgtagacagggattttctactgtatgtaggcttaattgggtaggcttgctggtgagtatagtatttatagttccttcagattagctatgaaagctatcactgctaccaaattttggttgtggagcaatcagcaaccttacacaatactaattgcatctctcaactcctagagtcgaagatccatcgattttgtggcataaggggatacatcactcacttggtattatcacctttctgttaacttcgttatcatctgtttgttggaaaacgaaggctgaaca

SEQ ID NO: 5892 - DNA, 107 bp, Zea mays
  misc_feature: Incyte ID No: 700350855H1
  unsure 52, 54, 68, 70, 75, 80, 85, 95, 98: a, t, c, g, or other
aaaccctagcagccgcccggtgctccctctctgcagatctcccttcgcagcngngaggaacctctttnanagcgnggaanatggntgaacagatngcntagttgtgg

SEQ ID NO: 5893 - DNA, 308 bp, Zea mays
  misc_feature: Incyte ID No: 700350856H1
  unsure 41, 264-265: a, t, c, g, or other
aaaagaagttgcaattacaaatcttacaaactacctcactnaagaaaacagagctgaggagctgcgtaatcttttgaccccagctcagaccattttttgcagttattcctaaggcaaagactgcaaaaattgtccgtggaataattgatgctgtcgccaagatacctggaacatcagatcttcagatttcactctgcaaggaaatggtagaatggacccgtgcagagaagcgtactttcctccggcaacgtgtggaggcaagtnngcagctctcctgttagagaatcaggagtatactgaagccctta

SEQ ID NO: 5894 - DNA, 305 bp, Zea mays
  misc_feature: Incyte ID No: 700350859H1
cagttcacagtataagattgccaaaaaacagcactgttggcgatgtgctaaacgatatcaaaacaaaggttgagttatctcatcccaatgctgaactgagattacttgaggtctttatcacaagatatacaaggtgtttgcaccaaatgaaaagattgaaaacattaatgatcagtactggacactgcgtgcggaggaggttccagatgaggagaaaaaccttggtcccttgatcgattgattcatgtatatcattttacaaaagatactcaaaaccaaacgcaagttcagaactttggagaact

SEQ ID NO: 5895 - DNA, 302 bp, Zea mays
  misc_feature: Incyte ID No: 700350860H1
  unsure 67, 103, 107, 118, 134-135, 144, 148, 166-167, 171-172, 211, 215, 231-232,: a, t, c, g, or other
gcccgttgcatccggctaccgcagcgtcgccaaccgtcacagccggtctcctccctccgctaccatngggaagacacgcggtatgggagctgggcgcaactcnaganccaccgcaganccagaggtgggctgannaggcatacnagantagccacttgggcaacgnntggnngaaaccttttgctggatcatctcacgccaatggcatcgntctngagtagattggtattnnggcnaancagccgaatctgccatccgtaatntgcncgtnntcagctngtnnagatgggaatanntttgnc

SEQ ID NO: 5896 - DNA, 307 bp, Zea mays
  misc_feature: Incyte ID No: 700350862H1
  unsure 79, 106, 132: a, t, c, g, or other
gtcatcgtgtctcctcgatcccctctcgttcctccctcgtcgcctcatcaattcaagatccaatctttgctgctgccantcggcgatccgatcgttctcgagcaangtcggtggccatggcacgctgccgcnatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggt

SEQ ID NO: 5897 - DNA, 309 bp, Zea mays
  misc_feature: Incyte ID No: 700350863H1
gaagaaaccgtcgtccaacaaggaattgaaaggtgcccattcctggaggaacatcaatgagcctacaagtttttccttctcgtccgtcaacttccctattcccgcaagaggagccaagggaccgattttcgaagatgggcctaattttgacatggcatttcgagttttccatggtagagatggggttgttccactttcagaagggtcattggcccagattgagaagccactgccaaagcccaatcctgagttcaacccattggcagccaaagcagcaaccatcagtctatctgcatttggagggttttt

SEQ ID NO: 5898 - DNA, 304 bp, Zea mays
  misc_feature: Incyte ID No: 700350864H1
  unsure 29, 234, 279: a, t, c, g, or other
atcagcttggagtcaggattaaggctggnctgttctacagatttattggcttccgtgaacaggatgtaagcaacttgaccaacttcatacaaaagaatatgggtgtcacaccagatgaaaaacagctttctgttagtggccagaattggggagggattgatatagatggaaacatgctaacctttatggttggttcaaagcaagcatttgaggtgtccctaccagatgttgcanaaacccagatgcaaggaaaaacagatgttctcttagagctcctgngatgatactatgggagccataagaa

SEQ ID NO: 5899 - DNA, 295 bp, Zea mays
  misc_feature: Incyte ID No: 700350866H1
  unsure 244, 247, 252-255, 260-261, 276, 291: a, t, c, g, or other
gacttaggtacctttgggaggaggcagatgcagaaacccttcgaggacgccacatatgccctcaaggttggtgagctcagcgacatcgtggacactgacagtggggttcacatcatcctgcggactgcctgaggaggggatcacactgtcctctcaggctttcagttagtgctatggcgttctgttagaacctgtatttgtattcctgctgggagcctgagttccattccgtgcaaagataaancangtgtnnnncacannttgcaacagcgtttngttaacggcttatgngagg

SEQ ID NO: 5900 - DNA, 298 bp, Zea mays
  misc_feature: Incyte ID No: 700350867H1
  unsure 55, 82, 229: a, t, c, g, or other
cgcatcccggcagtggcgacgaatctcgcggggcggaggtggtggcgcgacagangcggtgtcgactccgacgaactcgcanacaaccggtggatacgcaccagcagcaccggcgcactccaccgacgttcatatttaaggacttggtttggatagttctactcgtcaacaaaagtgattaaaaatggtggttcttgcagcttcaatcgtttaaaagtcggggaaagcnttgtttcaagacagtttgttgacatgtctcgcataagaattgaaggattacttgctgcgttcccgaaac

SEQ ID NO: 5901 - DNA, 99 bp, Zea mays
  misc_feature: Incyte ID No: 700350869H1
  unsure 35, 45, 48-49, 73, 79, 82, 89, 97: a, t, c, g, or other
ccgtgtcatctgtagcatgcaccaccgtgctcgtnttcagaaganganntcgccgtcgcttgtatccggtgcnggtcancgntcctggnctgatatntt

SEQ ID NO: 5902 - DNA, 299 bp, Zea mays
  misc_feature: Incyte ID No: 700350873H1
  unsure 47, 225-226, 240, 244, 269, 273-276: a, t, c, g, or other
gcggcacccaaatcccaaaccctagcatacgcaccatggcggcgcanagaagatccggtggggggagctggaggaggacgatggcggggacctcgatttcctcctcccgccccgcgtcgtcgtcggacccgacgagaacggcctcaagaaggtcatcgagtaccgcttcgacgacgacggcaacaaggtccgggtcacgaccaccacccgcgtccgcaaactcgnncgggcgcgcctctnccgnatcgccatcgagcgccgccatggcnttgnnnnggggacgcctcaaggagaagccg

SEQ ID NO: 5903 - DNA, 302 bp, Zea mays
  misc_feature: Incyte ID No: 700350874H1
  unsure 2, 97, 179, 275: a, t, c, g, or other
tnactattttcaccttgtttgccacaaagacagaggcatccctgttacgcatgctaaagggttcacctgatgtttacttaagtggcccaataaagangtatataacagacaggggtggtaggtttcacttaaggtggggatgcagagaggttctctatgagaaatcacctgatggaganacctatgttaaaggccttctcctcaccaaggctacaagtagagagataatcaaagctgatgcatacgtcgcagcctgtgatgtttccgggtatcanaagattacttccatcagaatggaggga

SEQ ID NO: 5904 - DNA, 301 bp, Zea mays
  misc_feature: Incyte ID No: 700350876H1
  unsure 98, 215, 229, 239, 244, 258-261, 265-267, 273, 275, 282, 287, 296: a, t, c, g, or other
cttgaagaacatgttccccagtgagaaagagatagttgttaaaagtcaaatccttgctggtggccgagggctgggaactttcaaaagtgggctgcaangaggtgtcctattgttaaggctgaggaagctgaaagcattgcacgtaaaatgttaggccagattctggtaacgaaacaaactggtccggagggaaagattgtgagcaaagtctactngtgtgagaaactgnctctcactantgtgntgtatttgccatcnnnntgcnnngggaantncgggacncccantaattgccnggccg

SEQ ID NO: 5905 - DNA, 305 bp, Zea mays
  misc_feature: Incyte ID No: 700350877H1
  unsure 6, 14, 51, 74, 139, 172, 196, 214, 220-221, 254: a, t, c, g, or other
gcgaanggaggaanggcaagggctacgcggtggacttcctcgccatctcgnttcacgctgtgtcgcgcgacctncgagggcgtacccctcgccctgtatctacactcagattgaggcagccgttggtacagaagaggangctggggaatcaaatcctgaagcaaatgaactngagctatctagagtatctgaaatnaggctcatactagcggancccggnnaactggatgcactttttgatgtcctcttctcancaagcacatctggagcagtggtattccgcagtgtgccgaagcgtgtccgtg

SEQ ID NO: 5906 - DNA, 292 bp, Zea mays
  misc_feature: Incyte ID No: 700350879H1
  unsure 106, 199-223, 244, 251, 254, 256, 261, 285, 287: a, t, c, g, or other
caaaaaagaaagtgaagtgaagaatcaaccaacaatggccggcggaatccaccgaccacaatgctgattttgtttgagccatctggactggactggaccctataanaaacagatcagatctcccccaccctcgcttccccagcctgcaggttgtcgtcgccctcttcctcctccttcgctgttgctgttgctgttgttnnnnnnnnnnnnnnnnnnnnnnnnnaatcaaactaatctgatcganaccaganggncnagagngatcccccaaaccaagagaggagnangggtt

SEQ ID NO: 5907 - DNA, 303 bp, Zea mays
  misc_feature: Incyte ID No: 700350880H1
  unsure 86, 116, 203, 211, 298-299: a, t, c, g, or other
atcccgtcgcatcccatcccactaccacccatctcgtcgtccgccgattcgatccggttcttccaacccaggggcagtgatggcgncgaagaggagcgtgggcacccttcggcgangcggatctgaaggggaagaaggtgttcgtgcgcgccgacctcaacgtccggctcgacgatgcccagaagatcaccgacgacacccgntccgggcntccgtccccaccatcaagttcttcttcgagaagggcgccaaggtcatcctcgccagctacctgggtcgtccaaaaggtgtcacccgnnagta

SEQ ID NO: 5908 - DNA, 292 bp, Zea mays
  misc_feature: Incyte ID No: 700350881H1
  unsure 70, 90-92, 94, 100, 106, 112-114, 126, 128, 135, 155, 160, 185, 223, 275,: a, t, c, g, or other
cgcagttggaacgaagaggtatgatgctcattcaggaggggagcgtgagattcaaagaactatgttgganctgctgaatcagtagatggnnntnactcangtgganatgttnnngtcattctagcnanaaaccgnattgaaagtcttgatccagncttgnttcggccaggccgtatagaccggangattgaatttcctctaccagatattaaaactagacgangcatcttccagatacacacatcgaaaatgacattagctggtgatgtgaactnggaagagtttgttatna

SEQ ID NO: 5909 - DNA, 78 bp, Zea mays
  misc_feature: Incyte ID No: 700350882H1
  unsure 13, 18, 21, 31, 51, 54, 59, 70: a, t, c, g, or other
ggaacgcacacancgtgngtnagcgatctcngattcactagtggattcagngangaaangctcttgattncggggact

SEQ ID NO: 5910 - DNA, 290 bp, Zea mays
  misc_feature: Incyte ID No: 700350886H1
  unsure 6, 16, 38, 43, 71, 90, 93, 96, 108, 160, 183-184, 195, 198, 208, 216, 225,: a, t, c, g, or other
cccgcnaccagccttntcgcatcctcgaagcacggaangctcncagaaggagctctcacctcgcagccatntctggcacgtccgtcctgnttntcnctcggtccctcnccttctccacagctatcggattggcgttggagtggagatcgacccgggctcngaattcccttcgttggtaagganncctaatttggnganatgggattcnaattcganaaagcccgntaggtcgatngatctcagttgacgcgaaggattngaaaactaagttncggggtanttaatattct

SEQ ID NO: 5911 - DNA, 289 bp, Zea mays
  misc_feature: Incyte ID No: 700350887H1
  unsure 84, 88, 95, 97, 99, 110, 126, 132, 136, 139, 148, 153, 165, 204, 229, 247,: a, t, c, g, or other
tgcttttgtttatgtgatttgttcagaagttctgccggcttattgccaacggtctatttttacattagcaatgagtatgctggncctnggcaggnanantgtgtcacgtngctgaactgtcggacngctaangtgnctntcatctccnaaatngacccttacctnagaataggtgaagacttgcaactctatgtaaggttgcantcggatctaggcagctatggttctnaaagtgatcaagagatgncanatccatgcttctgactgcaggacaaaagtagggttaacg

SEQ ID NO: 5912 - DNA, 288 bp, Zea mays
  misc_feature: Incyte ID No: 700350888H1
  unsure 26, 94, 152, 237-238, 242, 245, 249-250, 276: a, t, c, g, or other
tccggaccgagcgcgaccccacctcncagatctcatctgcgacgacctcctccctcccgatcccgctccgtctccccccaccgccaccgctgcngctgccgcctcccccaccgaggtcttgtcttcggcgatccagccggagcccgcggcgncgacgatgtacgggtgggagatgctgtcgttcaacatacacgatgggttctggaggccatcgtgcggggcaaccgctcgggcctnntcancgncgcnnctacaacaactctgccagtgcgaganctcgagacataa

SEQ ID NO: 5913 - DNA, 291 bp, Zea mays
  misc_feature: Incyte ID No: 700350890H1
  unsure 4, 118, 149, 185, 190, 192-193, 237, 239, 259, 264, 274: a, t, c, g, or other
attntttctccctgccctcccctgctgaaggaagccgcctttttggagtttggacgcgggaggacagcctccgcatttcagtccgtcgcgaagaattcctgcccgggcgggcgtagancagatctcccatgctatcgtctgactctttngcgaccggaatccggctcggaccacgcatgcactgnatgtncnnggcgtagattcgttggggacgaacgtttagggccggggatcggngnacacgaggctgtgggttggngcaanaagcaaattntgggtcctagcttgaag

SEQ ID NO: 5914 - DNA, 279 bp, Zea mays
  misc_feature: Incyte ID No: 700350893H1
  unsure 23, 52, 72, 155, 160, 174, 190, 192, 206, 209, 214, 217, 221, 224, 243,: a, t, c, g, or other
agcaaacaagggcggacgcgganccggcggcggagcggagatggcggagaanaagcgaggagccggcactcncaaggatgaagtggtgacacgcgagtacaccatcaacctccacaaacgcctccacggatgcaccttcaagaagaaggcaccanatgcnatcaaggagatcangaagttcgctcagaangncatgggtactactnatngcggngtnaccntcnagaccagcaagcacgtctngagnannnntnaangnngtnnnangaagttctcggt

SEQ ID NO: 5915 - DNA, 289 bp, Zea mays
  misc_feature: Incyte ID No: 700350894H1
  unsure 29, 48, 57, 89, 95, 112-113, 119-120, 127, 129, 138, 145, 148-149, 153,: a, t, c, g, or other
ctgctttgcgcagtaagtaatagcaaganttatagcagacggtttttntttgttgtnacgcaagactttcgaagtgggtgtaagttgtnttagantggtggcagaggggggnnggggannaaatgcntnattttaaanccttttnggnncctnccnggnanagatggggttgttcccctttnanaagggnnattggcccagattnagaanccatgccanagcccatcctgagttcaacccattggcagccaaagcagcnncnatcagtctatctgcattggngggtttt

SEQ ID NO: 5916 - DNA, 295 bp, Zea mays
  misc_feature: Incyte ID No: 700350896H1
  unsure 78-97, 156: a, t, c, g, or other
accaccgatgcccccatctaaattgcttaataaaaagggaagcaacgaaaatggagattctgatgtcaatcctaactnnnnnnnnnnnnnnnnnnnnatgaaggaagcaatgcaatttgctgaagccagattaaaagctgcaaaagaattgatggngataaaaggtgtcagctctaaattccgtaagcggccagttcatcacaaaagcacaaaatcactgaaattaaggaatacaatgcacctgaaaaagcacatctatttgaagaaaagctggatatgagaagattggtaaagg

SEQ ID NO: 5917 - DNA, 306 bp, Zea mays
  misc_feature: Incyte ID No: 700350902H1
  unsure 57, 89, 234: a, t, c, g, or other
ttatattgagaaagaggatagcaagaagttgaaacagaaacagcgtgagcgtatgcngcccaagatgggcaaaatggatatagattatncaggttttgcatgacgcgttcttcaaatatcagacaaaacccaagctgtctagtcatggtgatctgtattatgaaggcaaagaatttgaggttaaactgagggaaatgaagccaggcatgctgtctcgtgagcttaaagatgctntggtatgcctgatggcgcccctcccccaggcttataaacatgcagcgctatggtccacctccatcttatccc

SEQ ID NO: 5918 - DNA, 298 bp, Zea mays
  misc_feature: Incyte ID No: 700350903H1
  unsure 43, 52, 54, 192, 233, 263, 280: a, t, c, g, or other
gaattggtgtaattcctgccacattagatccaaaccgtttaantgataacancncctggtcccctttcagcggctgaaagagaccaggcgttgttatcaattggtgtaattcctgccacattagatccaaaccgtttaattgattattactacctattgaagttatccagcttagctgataatctagcactncggggccatacagtcctgaggatcgcggctatgctcaatanggctgaaaagggcatgaacatgctatagantttggaactcatgaaangatgaattctgctatggt

SEQ ID NO: 5919 - DNA, 302 bp, Zea mays
  misc_feature: Incyte ID No: 700350905H1
  unsure 163, 204, 208, 230, 247, 270, 277-278, 296: a, t, c, g, or other
acccattctctctcgtccatcgcatcgctccggctcccagcgcaatcgatccatccgtgccctaggtgtgcttgcagctgatgcagttgcagcagcgtgcttcccctagagggaaaagcgtgtatgagcccagtgaggagaggcagtggaggttatgggagtnagaggatgaggatcaactgctgcagcatcaggcgcaacaangcangaggaggatgtgtttcagtgcnagggctgcgtgagcagnacccagtgtgtggtcacatcagntgctggnnccagacatcctgtccttncgaaca

SEQ ID NO: 5920 - DNA, 303 bp, Zea mays
  misc_feature: Incyte ID No: 700350907H1
  unsure 9, 16, 34, 40, 47, 290: a, t, c, g, or other
gtttatggngcgagcngtggccgctcgctttgtntgctgncagcatncgctactacggagagtccatgcctttccggtagcaaagccaaggcgtacagcgactccaagtccctggcgtatctcacggccgagcaggcgcttgctgactttgctgtgctgctcactgacctcaagaggaacctatcggcagagggcagccccgttgtgctcttgggggctcatacggtggaatgctagctgcttggatgagactcaaatatccccatattgctatggggctctcgcatcancagcttccgatcc

SEQ ID NO: 5921 - DNA, 302 bp, Zea mays
  misc_feature: Incyte ID No: 700350908H1
  unsure 2, 4, 8, 10, 12, 15, 18-19, 22, 26, 29, 31, 46, 70, 101, 109-110, 114, 135,: a, t, c, g, or other
gntnagancncnagnggnnggncttnatntntccaaaccctagttncccgattctcgatggcgaaccctngcgtacttcttcgagcatgaccgtcggcggngccccggnnggcnggatgcgtgatggagctgtangcnaacgaggtgcccaagaacgnggagaattncgcgngctgtgcacgggcgagaagggcgtgggcaagtccnggaagccgctccactacaagggctccaccttccaccgcgtcatcnccgagttcatgtgncagggcggcgattcanncgcggcaaggcaccggcgg

SEQ ID NO: 5922 - DNA, 300 bp, Zea mays
  misc_feature: Incyte ID No: 700350909H1
  unsure 14, 29: a, t, c, g, or other
caagtgtgtaaggngggacctcccctgcnctagctccaaacagaattagggaatacggtcaacctcccatggctactgccgtgtaggcgatctgacagtccacaaaaacctaagattcggcaccaagtcactaaccgaaggaaggtcgagatgaggaaggatgtgatttgatctcgaatatcaactacatctgtctagcgtcgagacacatgtgcggtagtgctaagttggttctgtctttcagtttctttctatatcctatttctgtgaaaatattttatgtgagtgatgtaaactgat

SEQ ID NO: 5923 - DNA, 299 bp, Zea mays
  misc_feature: Incyte ID No: 700350910H1
  unsure 294: a, t, c, g, or other
gacaatggatccaaggatgcagggaccggtgctcaggccacgctggagagactggtgtccaagcacaggcatcggcgtgaccctgatggccccccgtttgaaggcaggttttccgacgagtcatcatctttgctggagaggacgcttgaaatccgggacaggtcctacaggctcaagatcggtgtgatgagcgaaggcattccttcctgtatatggtgacgatgaaagcgccgccatgctgctgattcagatggcgaggagtttagccgaaactcaaggaagtgcggagattcngagga

SEQ ID NO: 5924 - DNA, 305 bp, Zea mays
  misc_feature: Incyte ID No: 700350911H1
  unsure 258, 300-301: a, t, c, g, or other
gcatgcaagcggaaatggcattgtgatcaggttctcatggagaggtgaaacatgtaaatgaagatgaaagctgagtcatctatactatatttgctatgcgtgtacaaacttggccggatatttggacaaccggcagcagagaaaagaggctggcttccagcccagtggctgtttcagtgacttggaatctgttgttcgatcgatgaacagttcttctgttaatgtcgctcggttaggctctacgctaattatcagatncacccaacgtggcatgtttcatgttttgcttaattggcccanntgtc

SEQ ID NO: 5925 - DNA, 306 bp, Zea mays
  misc_feature: Incyte ID No: 700350912H1
gaagatcagattgagcgtgttactcagattttgggcaggcggacaaagaacaacccctgcctaattggagagcctggtgttggaaagactgctattgctgaggggcttgctcagcgtattgctaattgggatgttcctgaaacaattgaaggaaagaagagcgtcggctccatggacgaggacgatgacagtcccgcctccggcttccggttcgccataagaagaagttgcgccttcattcagggcctccacgacggattcagcaaaggttcaaacaggaatatctctgaacacctgggctctcta

SEQ ID NO: 5926 - DNA, 306 bp, Zea mays
  misc_feature: Incyte ID No: 700350914H1
  unsure 2, 9, 12, 22, 26, 51, 54, 58, 88, 92, 114, 125, 151, 155, 172, 184, 233,: a, t, c, g, or other
gnggcatcnganttccttacanaggntgctttactatgatctagactttangantcancctaatgatggagcccatattctctacagnccancatctgggtgatctgtacaganattttgtcaangatttccctattgtatcaattgaggncccntttgattcaggatgacnggagttcagggncatcatgcagtcctcagttgatatcccaaattgtgggtgatgattcacncnccacnnacccagaacntatagcagatgctattgataanaaggctgcatgntctgttgctaaaggtcaacca

SEQ ID NO: 5927 - DNA, 308 bp, Zea mays
  misc_feature: Incyte ID No: 700350915H1
  unsure 9, 33, 37-38, 52, 56, 61, 90, 99, 101, 106, 112, 161, 172, 178, 194, 201,: a, t, c, g, or other
gtgagtctngctgagttgcagcatgatgacgtngcanntagaagattcaagntgantaacngaagatgttcagggtaaaaactgcctganctagcttcnanggcanggatcntacccgtgacaaaatgtgttccatggtcaaaaaatggcagacaatgatngaagctcacgntgatgncaagactaccgatggntacttgnctcgacngttcagngntggtttactaaaaaacgcaacanncngnnncggaagaccncttatgctcagcaccaacaggtccgccaaatccggaagaattgttggntnt

SEQ ID NO: 5928 - DNA, 311 bp, Zea mays
  misc_feature: Incyte ID No: 700350916H1
  unsure 38, 86-88, 105, 117, 239-240, 278: a, t, c, g, or other
gtctctgttgtaaaattgcaacagaaggacaaaaggantgggcgtccaaaaatttggatatacagggacaaagttactaatgaacnnnagggtgatgcaacagtncacctatgaggntccacatgctgcttcagctgctgtggaatggttcgataacaaggatttccatgggagcactattcaggttcacatagctgagtcaaaaagcaaagatgcattcgataaccccacgagtttgnncatcattggtggtgttggtgaacaagatgaactggatnatggagcaggcagaggcagagggcgtggtgatg

SEQ ID NO: 5929 - DNA, 252 bp, Zea mays
  misc_feature: Incyte ID No: 700350918H1
  unsure 96, 98, 101, 105, 115, 117, 144, 193, 200, 222, 231, 235: a, t, c, g, or other
cattaggaccagtagctgcttgatttgtgtctcggtgatctagctttgggtagtttgtgcagttggaaggagacagtttgttggttgtattgtatngnagngcanagctagcaantnttgttgtagccatcaggtacgtgttgncgtagtgaatccaggtccagggacagagctgttcctctgtatggtggancctgacnctttgttttgtgccaggggccnttctgtgtngtgnttacagagcggagctgc

SEQ ID NO: 5930 - DNA, 284 bp, Zea mays
  misc_feature: Incyte ID No: 700350920H1
  unsure 2, 6, 18, 21, 50, 104, 113, 125, 130, 137, 140, 150, 152, 159-160, 164,: a, t, c, g, or other
gnccanggaggatgcgcnccnccaccaagaacatggtcccgggagagtcngtgtacggagagaagcgtgtctccgtttcagaatgaggatggaacaaaagtcgnatacagggngtggaacccctnccgtnccggctngangctgctgtgntngtggtgnngacnacatcngaattgcncancataancgtgngctgtatctggtgcngcntctggcacaactgtancncagtgtcgatatgtanggccgatggtcggtctacgcgttgagttctctcacagagg

SEQ ID NO: 5931 - DNA, 294 bp, Zea mays
  misc_feature: Incyte ID No: 700350921H1
  unsure 2, 128, 281: a, t, c, g, or other
gnaacatgccaagaagcattactggatcctcaagaattggccaactatcttcttcaccacaagcaaaggatttatccattttccaacagtgatgtctcagacgaaactaactttggcattttcaatgntggcgaagttctccaagaaaagtgctcttccctgtgatatatgcatgcgatgtgatacaatattgaaccgtatttttgtttgctcgagctgctactgtacacttagattgctaccagagtctggtgtatcccactggcccaggaaatgtgaanttgccatgagatg

SEQ ID NO: 5932 - DNA, 160 bp, Zea mays
  misc_feature: Incyte ID No: 700350922H1
  unsure 2, 29, 31: a, t, c, g, or other
gntcatttaacggaatatatatgtaagtngntgagctgcagatgtggtacatttttatctcttagaaagatttcgaagcactgtactggagcggggcgggcgggggtatcatgtagtaggagttcatcagatgtggtacatttttatctagtaggagttc

SEQ ID NO: 5933 - DNA, 311 bp, Zea mays
  misc_feature: Incyte ID No: 700350923H1
  unsure 47, 92, 100, 208, 216, 227, 269: a, t, c, g, or other
gcatcactcgctcattcggagcccctctcttcgccggcgtcgtacgnagagatggcagagcgtttgacccgtatcgccatagttagcgaggnccaagtgncaagcccaagaagtgccgccaggagtgcaagaagagctggccccgtcgtcaagactgggaaggctttggcattggaagtgaactttcggcgtcgaaaacttcgctttncattctgnaggaactgtgncattcggttgtggtatcctgtgtaaagaaatggcccatttgnatggccatgcaaatcatcaacctttccaaaagacttgggaaa

SEQ ID NO: 5934 - DNA, 296 bp, Zea mays
  misc_feature: Incyte ID No: 700350924H1
  unsure 6, 48, 118-119, 125, 135, 137, 158, 164, 217, 230, 259, 287, 289: a, t, c, g, or other
caaggnacccaagccaaactagctagcctgcacttgcacccttaaganatacagcgagagagatgatgagagtggccgtggtcggtggtggcctaagcgggctagtggcggcgcatgnnctggcnaggagcggcngngcacgcgtcaccgtgtacganaaggangaccatgctcggcggcgccaagaccgttcgccgtacaatggtggatcaggccngttctggtacganctcgactttcatggtcttcaaccgggtgncgttctcaaacatgatggaatggtttgnangtctggg

SEQ ID NO: 5935 - DNA, 290 bp, Zea mays
  misc_feature: Incyte ID No: 700350925H1
  unsure 2-3: a, t, c, g, or other
gnnaagaagatcctggctgcaatgtcaaagaggatggataggaacaagtggatcattgggggaatcatcacggctctcgctctggccatccttttcatactctacttcaagctcgctcattaagcttgcctgcaggtaggttccttccacatatctgtgctcagtaattgtgtgataagagttgtctgaatgctgtgtattgagcgacacacggctctgaagcatcattattccctcccaaacctgtaaacttaacgtggttcagttgtgtacagttcagatacgtccaa

SEQ ID NO: 5936 - DNA, 292 bp, Zea mays
  misc_feature: Incyte ID No: 700350926H1
  unsure 2, 35, 208, 242, 276, 279: a, t, c, g, or other
cnccctgtcccgctaggattcccccgaaaccctcncccaaaaccccagagcggagaagagcgcaagatgttcggcttcgggcaccacggccaccacggccagaacccgccggcgcacggcggcgtgcaccagcccaccttcaagatcttctgcaaggccgacgaggggtactgccttcaccgtccgcgacggcaacgtggtgctggcncccgccaacccgcgcgacgagcaccagcatggtncaaggactgcgttcagcacccagtcaaggacganganggcaacctgcgtt

SEQ ID NO: 5937 - DNA, 290 bp, Zea mays
  misc_feature: Incyte ID No: 700350927H1
  unsure 208, 243, 252, 257, 259, 262-264: a, t, c, g, or other
tctcactcctctcggacccccggtggccggtgcagagctgcgcgaccgagaaccgaatctgtgagccatgtacgaccaacaagggcagcgcggccaagggcggcggagggaagaagaaggaggtgaagaaggagacgaagctcgggatggcctataagaaggacgacaacttcggggagtggtactccgaggttgttgttaacagtgnatgattgagtactatgacattctggttgttatatnttgaggccngggcnanggnnntctgggagcaatgaaagaattctttg

SEQ ID NO: 5938 - DNA, 295 bp, Zea mays
  misc_feature: Incyte ID No: 700350929H1
  unsure 45-46, 292: a, t, c, g, or other
ctttcgtcctcacgagtgaccgataatccgccggcgctaagatannggtttatcaagatctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggacgaaagcgttgatgacacagccgtgaaggtggttgatattgttgacacattccgtctacaggagcaacctcctttgacaagaantca

SEQ ID NO: 5939 - DNA, 287 bp, Zea mays
  misc_feature: Incyte ID No: 700350936H1
  unsure 101: a, t, c, g, or other
acaatacccgtcttgccttcaaatcgaactcctcccccgatcgatcccaatcgaacccaccaagccgataccctaaccctccgcccttctcgatgtcggcngccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggagttcgtcgaaatccaggaggagtagttaaagacg

SEQ ID NO: 5940 - DNA, 284 bp, Zea mays
  misc_feature: Incyte ID No: 700350937H1
  unsure 45: a, t, c, g, or other
cttcgtcccctccgtcgccttcacacctgcttgccatttgcgatntcaccgtcccgtcccgtggcgcaacgaccgccgccttccggccacccggtcgcggctcccccggattcgcgcccaccgcgcctccggatcgtctcggagatctgccgctgagggagttgcatataatctgagctggtgctcctcaagtgttcggaagaggtccctgttttattcgtttttgttggtgcgactgcgagtgtaatggaggaagtggaggaggcgaacacggaagccgtgga

SEQ ID NO: 5941 - DNA, 291 bp, Zea mays
  misc_feature: Incyte ID No: 700350938H1
  unsure 2, 4, 8, 24, 50, 102, 111, 115-116, 119, 122, 140, 142, 147, 151, 165, 174,: a, t, c, g, or other
cnanccantcgctcaaaaccctanagctctcgcctgctcgcctccgacgncggagcgagctccccatctttcatcccgtgcaaccatggagacccagatcantcaagaagnagannttngtnagcgacggtgttttctangncgagnttcnatgagatgctgacncgggagatnannggaggatggctactctngccgtggangtgcgngtnncgccgttgngcacggngatccatcatcnggggccacggncaacgnntaacgtgctnggtnaaaagggnngcaggtctg

SEQ ID NO: 5942 - DNA, 282 bp, Zea mays
  misc_feature: Incyte ID No: 700350943H1
atggaatgaccgaacttaatgatggaaaaccaagaaagattaagaatgcaagaccttattcttttactctagaagaagacaccacctgcatatggcacttatatggagaggtggtattgtcactacaggtgaagccaccgaagttcttaaattcaaaaccttgaaggaggcaatcaaggagccaggagaatttctcatgagtgatttctccaagttcgaccgcccacctcttttgcattggcctccagctttggacagtttaggacgaatgacagatcccta

SEQ ID NO: 5943 - DNA, 286 bp, Zea mays
  misc_feature: Incyte ID No: 700350944H1
  unsure 95, 123: a, t, c, g, or other
cctcatctgccaattcagccccttgttcaaaatcacagcatcagcgacagcaagcggcacaaaatctgccggatagctcttcatctcccaaccancctgccacttttacacaacagaagcagnagaaacaacaggaacaacagcagtctagacaaaatgagccacaaaggaaccgtggcagtcaacaagctaagcttatgaagagtttaggacgaggaaacatgatggcccagactctccattgactgcacaccaaccaatgctgcttctactccatcaaaaaacc

SEQ ID NO: 5944 - DNA, 260 bp, Zea mays
  misc_feature: Incyte ID No: 700350945H1
  unsure 38, 155, 201: a, t, c, g, or other
gatcatcaccattcatgaaaaccacccattaaccatangctgtttacactctttctgcaatgtgccaagggtgcacggcactatcattgtcgttggcctgattattgcaacaaagcatgagagcaagtttctcaaggaaaagtgaaatgaaaggngctgaaactgagactcccgaggaaaaaagccttcatgggagaggancacaaacgggcaaaaggaagaagtccgcatctcttcactacccctcaagggccgatgca

SEQ ID NO: 5945 - DNA, 298 bp, Zea mays
  misc_feature: Incyte ID No: 700350948H1
  unsure 3: a, t, c, g, or other
ganctgaagtgcttctaagcagcggaaatgatcactatgcccgtatttgggatacaaggaagcttgaagccaactctccccttgccagccttgctcatggacgggttgttaattcaggatacttttctccacgaagcggaaataagatcttgacaacttgtcaggacaaccgaattcgtgtatgggactatattcttggtgatctgcaatccccaagtagagaaattgtggcacagtcagatttcaatcgtcacctgactccctcaaagctgagtgggatcccaaaggtttcagttat

SEQ ID NO: 5946 - DNA, 308 bp, Zea mays
  misc_feature: Incyte ID No: 700350949H1
  unsure 63, 154, 156, 288: a, t, c, g, or other
cgccgtcgtcgccaccgccactttgccccgcctcgtcgcctcctccgacgaccaccgtccacnggcgacaaggacagcgacgatgcagtcggcggcgtggaggcgtcacctcctcgaccaccacctctccccttcaagctcggctgccatcgcngncttcagatccgcctcccagcccgggctcgctccccaagggttgtttggagcggatggcgcaagatgcatgtctgcgagggcgccggcggtaaagggtccgggcaatctcgtccgcaagggcaaccggaggangtctctgtgaatggaattta

SEQ ID NO: 5947 - DNA, 299 bp, Zea mays
  misc_feature: Incyte ID No: 700350950H1
  unsure 2, 18, 204, 227, 237, 239, 289, 293: a, t, c, g, or other
cnaaggccgacgcatggnaggcgctgtggaccataagcctgcacaagatcttcgcggccatcgccatgggcatcgcgctgctccggatgctgcccaaccggcccctcctctcctgcttcgcctacgccttcgcgttcgccatctccagccccgtcggcgtcggcatcggcatcattatcgacgccaccacgcaggccgggtggncgactggatcttcgccgtctccngggcttcgcnanggcatcttcgtctagtcttccattcaaccacttctttccaaaggtacggncccnaggccc

SEQ ID NO: 5948 - DNA, 297 bp, Zea mays
  misc_feature: Incyte ID No: 700350951H1
gggaaaccgtccaccagcaaagtttcctgttcctctaccaccatcaccttcaatgaaggatgacgagattctgctccatctcaggagctgagcaagcaagggtgtatcctggaggctgttattgaagcaagtgctactgaaattatcaatctcatggatagcctaaatgaatgggacagtaaagtgggcgatggtgactgtggaagcacaatgtatagaggtgcaacagctattctgaagatatgaaaagcgttaccctatgaatgatgcagcgggaacataaatgaattggggcac

SEQ ID NO: 5949 - DNA, 299 bp, Zea mays
  misc_feature: Incyte ID No: 700350952H1
  unsure 297: a, t, c, g, or other
tggcattggcatgatggaggatggtatggcatactttgatgcaatggatgataattcatttaatgatactctggggctccatacagcagttcagctggtagcagttcccatgcttttaatggcccagtccttacccaagaggtcaacaatactatgtgtacatatagtccaactcaaaaggttttagaacctaattttctagttggtgccccgtccatctgctaggttacctgaagctggtagtcattaaatgtgttgttttaccagatggtcaggctaagagtagtactatggaangg

SEQ ID NO: 5950 - DNA, 110 bp, Zea mays
  misc_feature: Incyte ID No: 700350953H1
  unsure 5, 10, 17, 27, 42, 48, 51, 54, 70, 75, 81, 87: a, t, c, g, or other
gccgnggcgntgtgccncaatcggccnatcctcctatttctncccctncanctncttcaagcctacttcncgganaacagngggcgntgggagcaaacgaaaacttaaaa

SEQ ID NO: 5951 - DNA, 301 bp, Zea mays
  misc_feature: Incyte ID No: 700350954H1
  unsure 279: a, t, c, g, or other
ctttgttcgtttctcggcaccctcgatcccgagcgtggttaatccacgcatcgaccggcgaacgccaccgtatcccatctcgaatacctccgcgctcagcgtcatggacggcttctccaaaacgatcggcggtggtggccctaacgttccggcgggatcccaccccgcgggcgggagccaggcggcggccagggggaggcgcgacgcagcggacgcatatccgtatgtgactggtacttcagtcatgccttgaaatacaaggatggtgtgatcatggcngtgacactggagcctcctacgg

SEQ ID NO: 5952 - DNA, 306 bp, Zea mays
  misc_feature: Incyte ID No: 700350956H1
  unsure 15, 66, 105, 110, 123, 191: a, t, c, g, or other
cagaggacacctggnccagcacaggcagctagaagggccggtgggcaccggggccgggaagccccnaccttcaccacctgagggcccctgggaggctcctctggnctggntgggctgggtctngggccgccacaggcccctcacggggcggcagaggcaacttcagtgtccctgttagagcaacacgggtnccctaccgtggggggctgggtgcggccccctgccgtgtatttcctccccagggagtggggcctccccgggagctgacgccaccaccctgcttagcccttcacagggccccaaggt

SEQ ID NO: 5953 - DNA, 306 bp, Zea mays
  misc_feature: Incyte ID No: 700350960H1
gtttgttagcgtgacgtgcgtgaggagtctggagtcggacggaatcgaaaaggcgaaaacttcagtgtctcgagtttctcggagcggaggcgatggctgggaagggagggaaaggcttgctcgccgcgaagactacggcggccaagtccgccgagaaggacaaggggaagaaggccccaattctgcacgctcctcccgcgccggccttccagttccctgttgggcgtatccaccgttcagctgaagcaaaggactcaggcaaatggttcgcgttggtgccaccgcagccgtctattccgctggcca

SEQ ID NO: 5954 - DNA, 297 bp, Zea mays
  misc_feature: Incyte ID No: 700350961H1
ggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctggatgaggaatgcatctgcaaagggaattcaaatggaggaacctttgatgtgtttgaagagagtccctctatgaggcgtgcacctgtg

SEQ ID NO: 5955 - DNA, 298 bp, Zea mays
  misc_feature: Incyte ID No: 700350962H1
  unsure 66, 119: a, t, c, g, or other
aagccactcggatccatctcccactctcccctcctcgtcatcggctcctccgcctccacctccgcncgccccctgatccggatcgacgacgccgaccccagatccctttcctctccgcngtctccccgcccgcccgcccgccgatcccacatccctcccaggccttcaagcagtgaaggagccttatgagctggttggctggggctttactccaattctggtgctactaagatgggccagggcctgctcagcaacaagtctgggacaagactaagcatagatgaaatagcaggcgctt

SEQ ID NO: 5956 - DNA, 299 bp, Zea mays
  misc_feature: Incyte ID No: 700350964H1
  unsure 2, 182: a, t, c, g, or other
gnagaaggttccttctgcatcagaggatataaagactatgttaaggtctaatcaaaatgtgtccttggatagtgatgttccttactgctatctctcgagattggaaagttcatatggagagctcaccattggatgcaacctaaaaaacatgagaaaagatgagtggctatctgcccaacaancaattcttttgggagctgctaggattatccaaatcacatggcattgaactgggaagcaccatgcagtgctgttaattcacgcttctggcactttaagtaggataaataccgttagcc

SEQ ID NO: 5957 - DNA, 298 bp, Zea mays
  misc_feature: Incyte ID No: 700350967H1
  unsure 21, 78-99, 183, 239: a, t, c, g, or other
gcttcgtgttcccttcccgcncggccgaagcgaacaagcaaccgccaccaatggctgcgtgaccttgcgggcgaggtnnnnnnnnnnnnnnnnnnnnnnaaaggagcaaggaggcttccagaagctttcgtccatgcaagctccacctgagagatacgggctcgccgcgatggaattcgagtncagcggcgcggcggcggcagcgcagactctcttcgctgtcgttgaggacccacctncacgccggcttttgacgccgtggccggtggggaaggcggcgtgtctgggtactcttcac

SEQ ID NO: 5958 - DNA, 301 bp, Zea mays
  misc_feature: Incyte ID No: 700350968H1
  unsure 2, 9, 22, 25-28, 38, 51, 54, 61, 68, 71, 74, 76, 107, 112, 125, 136, 153,: a, t, c, g, or other
gngtatgtngtcgtcgtccganctnnnntgagcaggtngccaccgccctcngcngtgtganccccgtnacngcngngcctgctgtagaccgtggaggcgcgccgganctggnggcggcgattcancgccgaatggnctcgcaacgcgccaggngtgcngacgcttctacgcgaagttacgnntcggcccggttcgctacgccgaccagaacttctcacgccgangagttacagctgaagggantcaaggatcagctccgggactccagtcgcagttnaaggagtntcttacaattcaattc

SEQ ID NO: 5959 - DNA, 297 bp, Zea mays
  misc_feature: Incyte ID No: 700350969H1
  unsure 2, 18, 62, 73-74, 78, 118, 170, 215, 217, 241, 243, 262, 274: a, t, c, g, or other
gncagctctccggctgcntcccccacgagctcggcatgctcaccaaggcggccgtgattgangtgggcatganncagntcaccggcccaatcccgtcatctttctcgtgcctaatcancgtcgagcagctcaacctggccggaaaccgcctctacggtcaggtacccgangcgctctgcaagcttgctgggcccgctggccgcctcgacaacctnangctgttccggcaacttattcacancngccggggcggcatgcgcgncgctgatcaaanacggatgctggactgaagaacaa

SEQ ID NO: 5960 - DNA, 300 bp, Zea mays
  misc_feature: Incyte ID No: 700350971H1
  unsure 2, 20, 35, 46, 51, 62, 75, 85, 110, 146, 226, 230-231, 289, 293, 299: a, t, c, g, or other
gnggcgccctggcggcgagncgcgctgtgcgagtntcggagatggnggggnttcagcacctncggccgtcatggncccgccgganacccccgctggggccgatgcccaanagtgacatcgacttgagcaacctggagcggctgganaagtaccggagcttcgaccgctaccggcgccgagcagagcaggaggctccaggccccgcactggtggcggacctaccganagtnnttcggggagaagacagatcccaaagagcaagttgatattgggctgcttccacccaaantctnccgganc

SEQ ID NO: 5961 - DNA, 302 bp, Zea mays
  misc_feature: Incyte ID No: 700350973H1
  unsure 44, 49-50, 63, 66, 106, 194, 264: a, t, c, g, or other
ctccagcaagttttcatcatggatgaactggatgaacgggagtnggttnntgcatggtcaagncanagacaccatcattgatcagcttaacaggattgatcctctnctgagcagggaggaccatgaatcgagccaggaacttggaggctcagtttaacgagatctcccagatggcagcgatcggtattctatgncgcgtcctaaagaacgccccaggcctcagggaaaggctactgacagtccccatgctggcacagtttcctncaagaaccttctcactccagagggtagtgactgaggaa

SEQ ID NO: 5962 - DNA, 299 bp, Zea mays
  misc_feature: Incyte ID No: 700350974H1
  unsure 2, 97, 292, 296: a, t, c, g, or other
gnacctgcgccgcgccgcgccgcgctgcgcagccattccttgttctgtcccgggtacgccgccacacacatacagttcaagcgcttctctccctccntcctcttcgtggatcggaatcgacgcctggaagtggatgacgatggcgggttcttgcgccgcggtgcccgttgccggtctcccctcgttgaggacgccgatgccaacttcacctcagacttggcggctttatgccctgttcctcggccgcgcggagtcgcggcgccgccgtgctgggatgcgctcttggggccangaancaa

SEQ ID NO: 5963 - DNA, 292 bp, Zea mays
  misc_feature: Incyte ID No: 700350977H1
  unsure 28: a, t, c, g, or other
ataatttgcctcttctttcaagaatgtntttttccctgcatatcaattgagggaaaaaggcaacaacaagacattctgcctgatcagccaaggttaagaggcactgagtgcagtagggggccaaatggctattcaatcaggaaaacacatagaaaatttaactgacacagtaggcggttccactactaccatatcaaacttggaatcatgtcaacatgcaacgtgagagggtctctagctgaattggttaggtggtctgagtagcactcaggttgactcctcgtgggagcga

SEQ ID NO: 5964 - DNA, 292 bp, Zea mays
  misc_feature: Incyte ID No: 700350980H1
  unsure 45, 233: a, t, c, g, or other
tctgctgcagctagggtttagaggttttctgggcgcggaggggangcggcggcggctatggctgcggcggaggaggagatcgcggtgaaggagccgctggatctgatacgcctcagcctcgacgagcgcatctacgttcaagctccgatccgaccgcgagctgcgcggcaagctccatgcgtatgatcaacatttaaacatgatacttggagatgttgaagaggtcgtgacgnccgttgagatagatgatgaaacatatgaagaaattgtgcgcaccacgaaacgcatatcc

SEQ ID NO: 5965 - DNA, 287 bp, Zea mays
  misc_feature: Incyte ID No: 700350982H1
ggctcatgcagcatatggtgagtttcaacatgagaggcatgatgatcttgggagggcctataggcgatattagctgtgaatagtggtgagttatttagttaattacccatttcagatttttgatgttaagccctgcagttctaatgtagctagagataatcatttcgttgtttgagcaattggtgtcctgctaggtaagctaattaaagagctgtgactgtcaatagctacaggcttgggaagcctccgtcttattagaaaatgttgaccaatgttcccttcctaaa

SEQ ID NO: 5966 - DNA, 286 bp, Zea mays
  misc_feature: Incyte ID No: 700350983H1
  unsure 86-87: a, t, c, g, or other
taacgctgaggcagcatcttccccgccgtcctccgccgcctcccattttcaccttggctgcagcctgcaacacaatcctacgcttnngacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcatatctgcattggaaggtcatctgttccagaatggctttgccatctcttc

SEQ ID NO: 5967 - DNA, 287 bp, Zea mays
  misc_feature: Incyte ID No: 700350984H1
  unsure 14, 21, 54-55, 94, 218, 272: a, t, c, g, or other
accggatccatttncctctcnggggagcggattgggtagttgcctgcttagtgnntagttcttggcgtggcggctaactattgtgaattttgtnttagtctgtcctgttggcttcttccttccgcttctcctttctggccgccgaaggaaaccacgcggcttgttcttattgaatccatcaaggacgcaggaaagataggatcttcggctccgatctnggagcaaaagcgcgaccgcagcgggttttggtgcttcctttctttaaggttgtntccttgcaaaagttg

SEQ ID NO: 5968 - DNA, 286 bp, Zea mays
  misc_feature: Incyte ID No: 700350985H1
  unsure 105, 107, 125, 129, 198: a, t, c, g, or other
ggctgccgctagggttttagtgcttctctcccggcggcgcctccacatctcgtctctcagatcgggaggcgaaaccaagggcatacatatacatatttgcagtgngnccatcataacaagtaaantccngtgaagttcacggctgaagagctccgtgccatcatggacaaaaagaacaacatccgtaatatgtctgtnatgctcatgtggaccaggcaagtctacacttacagattccctgtggcagctgctgggatatgcccaggaagttgctggtgatgttcgc

SEQ ID NO: 5969 - DNA, 276 bp, Zea mays
  misc_feature: Incyte ID No: 700350988H1
  unsure 24, 57, 167: a, t, c, g, or other
gattagaccttctggagaagtaancaatttgtccatcttaggagcaatttggaatgngagtttttatttttttctgtaacgcccatcctgcctgcagtagaccctttgggcttaagaggtcctacagattctaatagtttcctctttgtagatgtgttaacatattncaaatacttaggacatggcctggtacgtgacagatggtgtttaacatcatgtcatatgaagaacactctctgtgggccaatggaggtgtgccttaaaattctcatcttg

SEQ ID NO: 5970 - DNA, 259 bp, Zea mays
  misc_feature: Incyte ID No: 700350990H1
  unsure 45, 80: a, t, c, g, or other
gcgatctagcgcttccttgttctcgcctcgtcttccccaatcgtncgccgggagcctcccgatccttcttccaccccacncggtcgtgccagggccggcacgcggacggtgcttggactgcccttgtcatggatcgcgccgagctcaccacggagcaggttctcaagcgagatattccatgggagcatacatgtcaactaagcttatctccggaacgtgccttcagcttttacggcgatatgaccacaaaccggagagc

SEQ ID NO: 5971 - DNA, 284 bp, Zea mays
  misc_feature: Incyte ID No: 700350992H1
  unsure 70, 83, 238, 258-259, 283: a, t, c, g, or other
tgaaggtccccccaagaccacctggttatgcttttgttgagtttgaagatcctcgtgatgctgaggaggnaattgctgaacgngatggatacaactttgatggacaccgtctaagagtggaggctgctcatggtggtagaggtaatgcttcctcgcatgatcgttcaagtggcttggtggcggtggtggagcacgtacgtggtgtgtcgagacactccagagtatcgtgttcttgtcnactggaatgccttcttctgnnatcagggcaggatttaaaggatcng

SEQ ID NO: 5972 - DNA, 285 bp, Zea mays
  misc_feature: Incyte ID No: 700350993H1
  unsure 111: a, t, c, g, or other
aagagcgctcccctaccctttttcccctcctcgcagtcgcagcagcagcgcacaccagaaaagcttttctgcctcctctccaccttgcttcccgcaactaccacgcacgcngaatacttggcaagatgataccctttctcgtcccgttgaactggcgccgtcgactccaccggggcacgctgtcgcgggttgctctccggtcctcgttctccttgctgctgaatccgctagtggagatcgacctgatttctcctgtcctgtccaattggatttagcccggctttc

SEQ ID NO: 5973 - DNA, 301 bp, Zea mays
  misc_feature: Incyte ID No: 700351001H1
  unsure 63, 69-71, 73, 98, 155, 260, 274, 288, 293, 295: a, t, c, g, or other
ttctcctcaaccaaattcaaagtcacagcggcgaaactctcggcgatgtctggccgcggcaanggcgtnnncnttctgggcaagggcggcgccaagcnccaccgcaagtgctgcgtgacaacatccagggcatcaccaagccggcgatccgcagnttggcgaggaggggcggcgtcagcgcatctccgggctcatctacgaggagacccgcggcgtctcagatttctcgagaacgtcatcccgacgcgtaactaaacganagccgcgcaaattntaccgcatgacttnttacntntaacgc

SEQ ID NO: 5974 - DNA, 299 bp, Zea mays
  misc_feature: Incyte ID No: 700351004H1
  unsure 286: a, t, c, g, or other
aattatgactgggtatactctgcgaaatgctgaatacaggctttcttttgaaagaaatctagaactgcctgaagaaggtgtagaatgcctaaaaagtgatgtcactgaagataatcatcataacatcaatttgggaagactgtcactatttttagattatccgaagaagacatgctcaggaccctggaaaaaccgatgaagcatcatcttatgaaaatatgggagaagacttggtgacttaacaccacaggcagagggtatttattcgatgcatccctttgatgcnatgaaaagggttc

SEQ ID NO: 5975 - DNA, 304 bp, Zea mays
  misc_feature: Incyte ID No: 700351006H1
aagactgatgagaaaggctgtgcttctacacttaaagctttcattgattatatatctttgagggaaactgaaaattttcgatcccgaaaggaggaaaataagaattctatcacattaacaactattcatcagtcaaaaggtttggagtgggatgttgtgtttaatgtgcagtattcttcatcttcaggacgagcttgcatataccaaatattcctgccatatatgtagtgttaggcagacatgtggtagcgtctggcacctattgctgattaagcagcttgtcctctgtgaccggctgaagaac

SEQ ID NO: 5976 - DNA, 299 bp, Zea mays
  misc_feature: Incyte ID No: 700351011H1
gaggaagcgagaggcgaggggagagaaagttctcgagctagacgagcgccgtgcgaggagagaagcgagatgagcggtgaggcggcggccgtgggcggaggcgaaggagaggcgaatggcatcccgccgaacgtcaccatctatatcaacaacctcaacgagaagatcaagctagaagaattaagaagtccctaacagccgttttttcccatttgggaaattcttgatgtgcttgctttcaagactttgaagcataaaggtcaagcttgggttgtcttcgaagatgtcgcatcagtatg

SEQ ID NO: 5977 - DNA, 301 bp, Zea mays
  misc_feature: Incyte ID No: 700351013H1
  unsure 2, 263, 265-267, 269-270, 272, 274, 281, 286, 290-291: a, t, c, g, or other
cnaaagcttcagaatggcacacttccaaatggagatgcttcgaattcgaagagcaagcttacttcaacacacgatgtattgagaggtttggttgattggctctgttcacagctgaggaatcctacacacccgagctgctctattcctacttctatccatgcctctccactttgctaagagaaccatatgttaggacattatttgttccaagctgatggcatcaagctgctcatcccttaatttccccagcttccacacaacantnnnanncncncctgtanggaanttgnntctgcacggg

SEQ ID NO: 5978 - DNA, 296 bp, Zea mays
  misc_feature: Incyte ID No: 700351015H1
  unsure 60, 115, 186, 188, 190, 201, 287: a, t, c, g, or other
aatccaatcccttaaccccgcaccgaatccagccttcgaagcttcctcttcctcccggtnccggtcccggtcccggtcccggagccctgttcttggtacttaggacaagacgctncgagaccctcgagattgagagctcgctcgctcgctcggtgtcttcgccagctgcccaccctccttcctgancntncccccgctcgngcgtctcttctcggatgatgggcgaccatctcgcgttgatcgtggaccggctgctgacagagtcgacgctggaggcggcgatcggnggtgggaag

SEQ ID NO: 5979 - DNA, 295 bp, Zea mays
  misc_feature: Incyte ID No: 700351016H1
  unsure 4, 10: a, t, c, g, or other
gatngaagtnagcagttcttcgccgagatatatacgaccgcccacctactatgaattgggggaaaggtcgtgtcaccttgcttggtgattctgtccatgctatgcagccaaatctgggccaaggtggctgcatggctattgaggatggttaccagctggctgtagagctagagaatgcctggcaagagagtgtcaaaactgaaactcctatagacatagtttctcttgaggcgctacgagaagagagaaggctgcgtgttgctattatactggatggcagaatggcagcatcagg

SEQ ID NO: 5980 - DNA, 298 bp, Zea mays
  misc_feature: Incyte ID No: 700351017H1
tgaaattcatatggatcagttagggaatgttgatgaccgtaaaaaatctggggttcaggcattgcaaataagatcttgctcccagtgtgccattttggagtctggtgtgttaaggcagcctatgcggtcaaggggactgcttgctcggcctatattcattcaatgcttgctatagcagcagtctgcgtatgcgtctgtgtattcatgcgagtttgctgcggatcattctggaaaaccttcaatgggagaggctggattacggtacatatattgtggggacacacctgagccttgtgga

SEQ ID NO: 5981 - DNA, 301 bp, Zea mays
  misc_feature: Incyte ID No: 700351018H1
ctctgcccttaatccatcgacaaaaccgagcttcagcaatggctgccttgtcctctgcccttaatccatcgacaaaacctagcagcacacaggcacaatctcattcaggtcaagggtctcaaagagccgctgctgttgcagcactgtcccaatgttttgactgcagagggatctcatagcccccgccacagtaggtcgtccccaacatcagatgcagacaagactgattagttctattctccccatcattagaaacagggatgcagaagatgtccgaacagagcctgatgtctcacaggaa

SEQ ID NO: 5982 - DNA, 296 bp, Zea mays
  misc_feature: Incyte ID No: 700351019H1
  unsure 4, 125, 153, 156, 193, 223, 283: a, t, c, g, or other
gtantatacacaatatcacaattcacatatacagattcacaagcttaatacataattcacaaaacacattcacatatacataaatagtccatagtccattcaaataagtctagagtccaaaagtntattgtccattcaaatacacattcacanaantctagtcccataagtctctgtccataagtccataagntatcactactcatactcatcctcactgatnactccggcgggttgtgggagttttggcactcctcttcggccaccaggaaggtggcactcntccagcacatgga

SEQ ID NO: 5983 - DNA, 297 bp, Zea mays
  misc_feature: Incyte ID No: 700351021H1
  unsure 59: a, t, c, g, or other
gagccaccgatcgctcctctccactttccacattccagttccactccgcctccgctgcnggtcgccgactccgaaactccgacagtccgaccacaaggtcttgtgcgggatccacagaaggatgagtgaagaggataagactgctgcttctgctgagcagccgaagagggcccctaagtcaatgaaaggatcctctcttctctgtccaggaggtccgtagctgctcatccatggcatgatcttgagatcggtctgatgtctgctgttttcaatgttgttgttgagatcacaaaggga

SEQ ID NO: 5984 - DNA, 296 bp, Zea mays
  misc_feature: Incyte ID No: 700351022H1
  unsure 151, 186, 288: a, t, c, g, or other
gctgtgaatagttattttctttgcactcatctttgttggctttcatgaggctctaaaagtgagagttggagaaatacaaatcggtggacacgcatgaccaaacattcatagccgtggctataattttttcttcagacatggcgcttaatancgtctacgtgtagtctacctatatgtgagcagatntggcctctaggagcgagcacgtgtgtttgcatatggcatgcacgtgtgggttatagagtgactcgaaccaggtccatcgggttgcacaccatgtgagttggnagagtgtt

SEQ ID NO: 5985 - DNA, 90 bp, Zea mays
  misc_feature: Incyte ID No: 700351024H1
  unsure 12, 47, 49, 52, 58, 63, 67, 72, 84: a, t, c, g, or other
ggctgagaacantgataacatgcagtttccccctacatggtcttccncncanattatncttgngaangaatncccccctatgtngaatcc

SEQ ID NO: 5986 - DNA, 168 bp, Zea mays
  misc_feature: Incyte ID No: 700351025H1
  unsure 2, 11, 155, 157: a, t, c, g, or other
gnacctctcancatcttctgtacataaagagatttaacttatattcatttattagagaaatctctttatgtacagaagatgctgagaggccataaaaagatttctctaataaatgaatataagttaaatcaacacaaatttcgattttgaacaancntaaaaaaaagg

SEQ ID NO: 5987 - DNA, 290 bp, Zea mays
  misc_feature: Incyte ID No: 700351026H1
  unsure 62, 93, 119, 127, 244, 249, 286: a, t, c, g, or other
gatgaagcctggtccggattccattggaatcatcgctgtttcgcacaattgtagtggcgtanagcccgagcttgcggcctagtgagccttgancccacaaaggtcgcggagatcctcanggatcgcncttcttggtaccgcgattgtcggtgtgtggatattctccatgttatccctacgggtaatggtggaatatcgagcttatctacatgcagattacgcaccgacaactttggcggcacgngcgantttggatctccgatacataatggtcttgaggatgcantttg

SEQ ID NO: 5988 - DNA, 288 bp, Zea mays
  misc_feature: Incyte ID No: 700351029H1
  unsure 257, 281: a, t, c, g, or other
cggctgtgaatagctgggagctctagttagtttatatctgttcaaatctctagtttgcagtcatttgagaaacggaggagatcatgttcgttaaattgtgtgcttgttgctctggagttaaattaaaactgaaatttagaagctgcatcaccagtttcaggtcagaagaatcaaaatctactcttccaattatatggggccggcattgcctgccactggaatgagcataaaacttgagaatcgatccaattgtacgnaagggggcaattcaatcagtggcntatgcgg

SEQ ID NO: 5989 - DNA, 292 bp, Zea mays
  misc_feature: Incyte ID No: 700351032H1
  unsure 16, 22, 31, 85, 88, 96, 100, 114, 122, 129, 148, 168-169, 172, 177, 189,: a, t, c, g, or other
tttagaatggttacanaaatantaaattctnttaggataacccacattcatactgtctctaagcctttgagttcctaaatgattntgnaaatttgnatanctttgagttcctanatgatttngtaaatntgtatactttaaagttcantgtgtcacattcactggatnngcngatangaaatgtcatgngncngntagagtatctactgtaaacgtaatttnntttgcctcagtaattgncatatcgcaagtnattngccnagtcnctnangtnaggcctagncctggaagc

SEQ ID NO: 5990 - DNA, 291 bp, Zea mays
  misc_feature: Incyte ID No: 700351034H1
  unsure 260: a, t, c, g, or other
gctcggcaagctgctgtctggcgtcaccatcgcgcacggcggtgtcctccccaacatcaacccggttctcctgcccaagaaggtggcggagaaggcgtccagcggcggcagcaaggagagcaagtcccctaagaaggccgccaagtccccaaagaaggcagccaagtccccgaagaaggttagaaattagtcattcactagcgctctgtgtagcagttcgtgtttagatctgtggaacttatgtgttccagccaatttcnctttgcttgtggccctgatatgttcatggca

SEQ ID NO: 5991 - DNA, 292 bp, Zea mays
  misc_feature: Incyte ID No: 700351035H1
  unsure 138, 181, 236, 242, 272: a, t, c, g, or other
acttcgatctcttcactgccaccatccctctgctcgtctcgccgtcgactgtgtcctgtctgtgctgcagcgcagggaaagttagctcctgctcctgctacgatgcctcgaccccgcgcctctccacctcctccatcntcctccacgtggttgtgctcctcgagaccccgacacagtctcntcgtcgacggcagcaagctgtcatgtcttcgccaaaaataacgtgcgtcgcggcntctcangggtacgtcgaagcagatcggtaaactgcngtggtggcacggcacctcgc

SEQ ID NO: 5992 - DNA, 296 bp, Zea mays
  misc_feature: Incyte ID No: 700351036H1
  unsure 276: a, t, c, g, or other
cacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaaccattctgccgcagaaaggactaatcctcccccaccggagtatgagtttgctggttaagtgaagagccatccgcggacatgttgtttgcctggaggnagcgttaatcattcctccac

SEQ ID NO: 5993 - DNA, 280 bp, Zea mays
  misc_feature: Incyte ID No: 700351039H1
  unsure 37, 106, 116, 119, 148, 150, 156, 175, 199, 204-205, 255, 262, 276: a, t, c, g, or other
ggtaaaattagtgttgttcatgtgaagtctaagtaanaatacaaattagtgtgtgaagggcgcaatcgatatacacatttataccaggtttgattattgtggtgantgtgtttgtngantgtgtacggtaattctaacgcgcgaaatnanctgtanaaaaattagtaagtctatntgttagttctcacttggtcattcntactnncattgttacagagttagaataattcaagtatctagaacgcggcaatttgngaatgtntaggagtgaaattnatta

SEQ ID NO: 5994 - DNA, 283 bp, Zea mays
  misc_feature: Incyte ID No: 700351040H1
  unsure 51-52, 99, 166, 209, 258: a, t, c, g, or other
tccaaccatattcaactgcgtcattgagataccaaggggcagcaaggttanntatgaacttgacaagaaaactggactgatcaaggtggaccgtgtgcngtattcatcagttgtttaccctcacaactatggattcatcctcgcacgctttgtgaagacagtgatnctttggatgtactggttataatgcaggagccgtcatcccaggntgtttcctagtgcgaaggccatcggcttatgccgatgattgatcagggngaggcagatgaaagatcttgcagtg

SEQ ID NO: 5995 - DNA, 286 bp, Zea mays
  misc_feature: Incyte ID No: 700351042H1
  unsure 127, 285: a, t, c, g, or other
attctccgcccatcaactcagtcagcaggaagcaacccgcctagcgccctcgatccaaggacctcagagattcggccgtcgccactccggggccaagaaatgctcctcctgctcttcttctctgtcntcgccgccgttgccgccttcctctcttcaagttcgccaccgtcgtcgatggggattgacgctcgtatcccgcggtccgccgctgcgggagagggtcgacggcaagtcgtgtggattaatggagctagccgcgggattggggagttcttgcatgcattng

SEQ ID NO: 5996 - DNA, 290 bp, Zea mays
  misc_feature: Incyte ID No: 700351048H1
ggacacggtggatgatggcaagctctctgaaaggactatttctgatgaattgcctcaggaatcttcaaaggcagagcaagatgttagccgtcctgaacaagacggtacttgtatgaatggtaatacaggtactgcgattagcagtggtgctaccctaccagatactagcgaatctgatcaaggaccaccaaaagagaagactgaacaaccttgctatgctgatgacataacagataccgatcagttgaaatctaaccacatgaagtgcggattcgatactgcaaagctga

SEQ ID NO: 5997 - DNA, 289 bp, Zea mays
  misc_feature: Incyte ID No: 700351050H1
  unsure 41, 46, 50, 54, 61, 99, 135, 190, 203, 222, 261, 264, 268: a, t, c, g, or other
agcaccttcccaaaaaatcccccattttcttcgaggcgatngagancgtnaaanacagggnaccggacagcgacgatgtcggggcgcggcaagggcggnaaaggtctgggcaagggcggagcaaagcgccaccgnaaggtgctccgtgacaacatccagggcatcaccaagcccgccatccggaggctgnctcggaatggcgnctgaagcgcatttcggggntatctacgaaggaatacccgcggcgtcttcaagatcttnctncganaacgtcaatccgcgaacatcg

SEQ ID NO: 5998 - DNA, 275 bp, Zea mays
  misc_feature: Incyte ID No: 700351051H1
  unsure 36, 243: a, t, c, g, or other
cgccttcatgtcactaatcgacaagggcgtctcacntggaaggagcccatccaacccaacgaagaagcaaaatccccaatctctgcgccgccgccgttctgtgtcgttcttcgcccgccgtcgttccgtgtcgttcttagcccgccgccgtttgtagtcgcggcttcatcgtcgcgtaccgatccccaccgcccccattgccaccagaggtgtcgacagtctcagaaacaacccctccccagnttctcccctcagagctgatcgaccggtgcatc

SEQ ID NO: 5999 - DNA, 280 bp, Zea mays
  misc_feature: Incyte ID No: 700351052H1
  unsure 278: a, t, c, g, or other
aacaggtgacattaatgttttcgctcagatgattgacgacgcggaaggcctggaaaaaatcgagaacctacagagccatgataataatgaaatctatgaaaaggctgtgaagcttcttgagacttactggatggaggaggaagatgatgcaatggctactgctggggaagctgctcctgctgtttttgactttagccaaggtggcaaccctcctggtggtggtttgaacctcaactgaatacagtatttgaccaaaagggtgttaatccctcatgacnac

SEQ ID NO: 6000 - DNA, 283 bp, Zea mays
  misc_feature: Incyte ID No: 700351053H1
  unsure 71, 280: a, t, c, g, or other
ctttcttgctcgccacagcttcgtcaaagacacgcggaaaagaagaggaagggggaggcgactcgaccgangccggcgacttcgaccgaggcccggtttcaatctccggtccaccgattgcgtccagatctaccagcaatggcatcatcttcggacccatggatgaaggaatacaatgaagcatccagacttgctgatgacatcagttccatgattgccgacagagggtctctttccacatcagggcccagaaattatgcggcatacttcagccatcggngaa

SEQ ID NO: 6001 - DNA, 273 bp, Zea mays
  misc_feature: Incyte ID No: 700351054H1
  unsure 38, 47, 49, 81-82, 86, 104, 114, 134, 150, 198, 229, 245, 251, 256, 264: a, t, c, g, or other
gcagttcaggaggctgtctcatctgggaagatagaggnggtgaatangntggttgagatcggaactgcaccatcagctgannaggntagacaatttgcagctcntgtgtcaganggcgcagagaagcccattanctccatagcgccgaangtgtttctaggacgtctgcaatggtctcaagatggaaacaatgtgttnctcgttcagagagttggcgtccaaaattcgnatacaatgggatggtnatagcngacantgacaagnccaagcggg

SEQ ID NO: 6002 - DNA, 243 bp, Zea mays
  misc_feature: Incyte ID No: 700351056H1
  unsure 155, 171, 228: a, t, c, g, or other
actagttctagcagagcagccgcatcgaactctacctgcctttctctcgtccctggcggcggggcaggatggcggttctactgcgaggacggtgaaggatgtgaacccccacgagttgtcaagcctatccgccatctcaacgtcggcagatggantttctgatggttgacntgtgagatcgagttcaggagtcctcttatgacctgatgtataatcaggtgactgtancaagagtctattgaa

SEQ ID NO: 6003 - DNA, 282 bp, Zea mays
  misc_feature: Incyte ID No: 700351057H1
aaggtattgcaaatgtgagatgccgtacaaccccgatgacctcatggtgcagtgcgatgcttgcaagcactggttccatccatcttgtgtggctatgaccattgaacaggccaaaaagctagatcactttgtttgctcagactgtttcaaagaaaatggttcaaagagactttcaaatgcatatgccacttcaccaaattttgagcctaaggctgaaccaaaaagggcagaggaggtaacaaactgtgagtggtaaacatccatatgggtaaggggagatgt

SEQ ID NO: 6004 - DNA, 276 bp, Zea mays
  misc_feature: Incyte ID No: 700351058H1
attgacctttgcttcgccaatgaggatgaagctagagaggttatagggggaggtctggaatcagatccagaggaggcgcttgcgttcttgggcaagtattgcaaatgggctgtggtcacacttgcttcaaagggatgcatggcaaagcatggcaaacaggtcgttcaagtgccggccatcggggagagcaacgcgttggacacaactggagcgggcgacctgttcgcgagcgggttcctgtacgggctggtgaagggttgccgctggaggagtgct

SEQ ID NO: 6005 - DNA, 281 bp, Zea mays
  misc_feature: Incyte ID No: 700351059H1
  unsure 67, 162: a, t, c, g, or other
cggatcggaagcttccataagtttccatcgggcttcgccgctcgccggtatggcgattccgcaaggngtcttcgtaacgccgtcgcggcactttctcgcgctcgcctctgtcgccgccgtcgcaggggaggtcttcttccaggagaagttcgaagatggctncgaaagttcggtgggtcaagtccgagtggaagaaggatgagaacatggctggtgaatggaaccacacttcgggaaaatggaatggagatgccgaggacaaaggtatcaaacctccgagg

SEQ ID NO: 6006 - DNA, 132 bp, Zea mays
  misc_feature: Incyte ID No: 700351060H1
  unsure 20, 45, 58, 62, 76-77: a, t, c, g, or other
gtttcagttcatcgattcanttcttgcctgaggatccaggaagangacagcaatgggngaangtgcaggtgaccgnntcctgagccgccttccatcagcgtcaaggagcgcatttggcgaatcactctctgg

SEQ ID NO: 6007 - DNA, 283 bp, Zea mays
  misc_feature: Incyte ID No: 700351061H1
  unsure 161, 171, 180, 185, 198, 200, 203, 226, 242, 260, 262, 267, 281: a, t, c, g, or other
ggagagagaaggaaccaaaaaaaaagctcggaatttgtagtctccaagccgtgcgacgaccggacgggaaggggaagagagggagggccgccgctgaagtcgccgtcggtgaggagatcggttcctgcgtgcagaggcggcaacaagcgctgcagatggangagggtttgngatggctgntgacnaccatgtggtggntnacntagaacggctttggccaaattcncaaggatgacgggggnttccatcaaatttttgtngntatgnaaatgtccggctcncc

SEQ ID NO: 6008 - DNA, 290 bp, Zea mays
  misc_feature: Incyte ID No: 700351062H1
  unsure 40, 153, 164, 188, 192, 204, 208, 211, 214, 234, 239, 262, 272-273, 278,: a, t, c, g, or other
gctagctaggaagaggtacggtgctggctaagctagctanatccatcgtccatggagctgagagcagcagctacctatatatctagctggttttctaacgacgatgacgacgaccgcgggactagcatgatgcagctagctgaagacagttgncctgcgactgncttcagctacgaacaaggttcgancggncccggacaggantgtntcngcnttacgttgtcatccgggttnaagcnccccgggttccaaatattcccancattcttggnnagganttttgnaacctg

SEQ ID NO: 6009 - DNA, 278 bp, Zea mays
  misc_feature: Incyte ID No: 700351066H1
  unsure 174, 199, 206-207, 215: a, t, c, g, or other
catttctgactgccatgagaccaagcttctggagaggatggcggccagtgtcgagtgcttgtccgagaaggttagggactgtttccttgacctgggctgcttcccggaggacaagaagatccccctcgacgtcttgatcaacatctggatggagatccatgaccttgatgagcnagatgcttttgccatcttggttganctttcgnncaagaacnttcttaccctcgttaacgatgcacagaacaaggctggagatctgtacagtagctaaccatgac

SEQ ID NO: 6010 - DNA, 104 bp, Zea mays
  misc_feature: Incyte ID No: 700351068H1
  unsure 18, 22-23, 26-27, 92, 95, 97-98, 100, 103: a, t, c, g, or other
gatagatattggtatganagannaannctagaatgctatgtcctgttcaaaggagctttcttcagagcagtacctgaactgaagaatgctcngtncnntnccnc

SEQ ID NO: 6011 - DNA, 269 bp, Zea mays
  misc_feature: Incyte ID No: 700351073H1
  unsure 160: a, t, c, g, or other
gtggaagtttggaggttggatattctgactggtctccagacttcactggtacagacatcagcaagggcccttcaggtgagaagtccactagcaggtatgatgatgccaaagggagcaggaggggatcatcagagtattacaatcttgaaagacaccactntacagctcaaaaacaatcaagaaatgagcacagcactacaagacgcagagacatgacttgaagattatcatgatgaaaaaaatgacggaagaggggatcccgaaagcaa

SEQ ID NO: 6012 - DNA, 273 bp, Zea mays
  misc_feature: Incyte ID No: 700351074H1
  unsure 77, 87, 97, 106, 115, 121-122, 125, 135, 138, 142-145, 148, 150, 154-155,: a, t, c, g, or other
accgcgttcacggttcacgccaacgaacccaacttcagaaaaagctcgttctgcccccttccttcgcatcgaaacanaccctccgtntccaaaaganagcccaatncctaaatanccaatnnctncaaaggaagnggnttcnnnngcncnttcnntgcnggntcccganttgcagtcgctgccnggntccgaggnaacaagtcgtcgncttgctccancgtcngctcgccgccatgagcttnatcntcggcaagaagcagatcctgctgagcg

SEQ ID NO: 6013 - DNA, 272 bp, Zea mays
  misc_feature: Incyte ID No: 700351075H1
  unsure 183-184: a, t, c, g, or other
gtcggaatagtcctgggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgnncaggctaaactggtgaagggctcggcagactacatcggtatcaacgagtacacatccagctacatgaaggggcagaagctggtccagc

SEQ ID NO: 6014 - DNA, 275 bp, Zea mays
  misc_feature: Incyte ID No: 700351077H1
  unsure 58, 83, 92, 94-95, 262, 265, 268, 271: a, t, c, g, or other
cctgaagggtgtgaaggatttcctgtggaagcacgggggacggatgcgatcaactggnctcgcttaggatttcagaggatgtncttgccaantnngagaaaggccctgaatgcttgagcacaggaacgaagaaggggactgaagagctgattggaccatctctgaagcagataaaagcaatggggcataatgggctctattagtacagcgtgttcatggagcttccattctggaaatgcttcacatctgctccatatggaantgncgnccncccc

SEQ ID NO: 6015 - DNA, 277 bp, Zea mays
  misc_feature: Incyte ID No: 700351079H1
  unsure 75, 129, 153-154, 179, 245, 248: a, t, c, g, or other
caccactcgcatcgtgtgctcagtcagatccccgtcccgcatttcctaaggccagttggcattgaagacgatgantgcttctgcagctgctggtgtgcagatggtggctgcacgcccttgcatttcgancctcgccaggaattcttaccgcannggtttctaggactgattgcatgctncagtaccatgctacattccccaaaattcagtgctcctgggcctctaaggttaagcgcaatgatgtngtngtaagagccataatcggaagagtgtggcc

SEQ ID NO: 6016 - DNA, 273 bp, Zea mays
  misc_feature: Incyte ID No: 700351081H1
  unsure 48, 95, 99, 125, 156, 170, 197, 260: a, t, c, g, or other
acgtcattaccagacacttcacaggactcgatcaagttcgtgcaagangtgctacttgaagaccgagctaagctgaaggggatcccctccgactnctcnccagatcatggtgtggcagtacagcntgcccagctcgcgatagagggcagccgagangacgcacaagaggngtcgcaacctcgcaggcaggggaaganctgcagggggttggatcggagtcgctgtaaaatgtggtgggcgatggtaacggcaaggaaagnaagaaggctgatt

SEQ ID NO: 6017 - DNA, 270 bp, Zea mays
  misc_feature: Incyte ID No: 700351082H1
ctccattagtggattttattatgatccaaatagcagtccgtttcagaagctcgaattgaagtgtaccaatgagaaaaattctggattcaccttttcatcctatgagctgcagtgacagggccaaatgccctcgacagacaactttctgtcagcatatagtgtgtactgaactcatactccccaaatgctgctgtattgaaagaaaggagtggtggtttatgcaacacttcgttttctcgcaagagcaagaccaagcaaactgtcatttgt

SEQ ID NO: 6018 - DNA, 270 bp, Zea mays
  misc_feature: Incyte ID No: 700351083H1
  unsure 2, 4, 25, 194: a, t, c, g, or other
anancatggaggtgatttggagatnccaggtgatagctgtgttaattctgacgaaaacgctgtgctttcagaggatacactggtgcaagcagatcaattgtgttccagtgatgaggtgcagaatgagaacacagaagctgtaaccatagacagttcaggttgagctttcaggagatcagggtgggtatcttccncagtcgggtgttgattctggagttcaaccaggggagaaggtagagagtaaagatttgcctagaccaccgagactat

SEQ ID NO: 6019 - DNA, 266 bp, Zea mays
  misc_feature: Incyte ID No: 700351084H1
acactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttcctaattaggg

SEQ ID NO: 6020 - DNA, 268 bp, Zea mays
  misc_feature: Incyte ID No: 700351087H1
  unsure 97, 113, 138, 163, 166, 170, 201, 207, 223, 236, 256, 260: a, t, c, g, or other
agggaagtttgcattgcttgatcgtctacttccaaaactgcagagagctggtcacagggttctgcttttctctcagatgacgaaactgcttgatgtnttagaaatatatttgnaaatgtacaatttcaagtacatgangcttgatggatccacgaagactggngancganaggaggttactggcagattttaataagaagngattcngaatatttcagtgtcnctcaagcacagtncctggaggacttgggttganactngcagacgg

SEQ ID NO: 6021 - DNA, 264 bp, Zea mays
  misc_feature: Incyte ID No: 700351088H1
  unsure 47-48, 54, 69, 73, 105, 175, 185, 223, 231, 250, 254, 259: a, t, c, g, or other
gcggagcactgtgcaggcgaccgcggcgagctaccagtgacgggggnntacggnggcatcgtcccccgnggtncctcctccatccctggtgcggcggcgccagcntgcaggtgttgaatgctgatttgttgtggctgattaatcgggttgatcgtcgattaatcgtgattagtcngctgatcgcncctctggcgatcagaaacgatcaggcaatctgaaaacnttggccgncaaacctccagagcgactnccgngagcngtaac

SEQ ID NO: 6022 - DNA, 266 bp, Zea mays
  misc_feature: Incyte ID No: 700351091H1
gtccgccacatgctcgacctcgtcgtctccacctccggcaagctcgtggaaatttacgaggacaaggacaatgctaggaaggatgagatcaacactcatcttactgcacccacgcaaagtggactgtttagcaagtactatgaaaggctcaaagagatccgtgaatatcatcggcggaacccatctgcccgctttgttagtacaactgatgactatgaagagcttctaaaggaggaaccagttattgaattcactggcgaggattg

SEQ ID NO: 6023 - DNA, 269 bp, Zea mays
  misc_feature: Incyte ID No: 700351094H1
  unsure 115-145, 153: a, t, c, g, or other
cacgcctccccatccacctgtcactcttaccgccagccccacatcacggagcatcccccccttaataacagcaaactaccacacccatgtccacctccgtctccgtctccgtctnnnnnnnnnnnnnnnnnnnnnnnnnnnnnnntctcgtcncacccctcaccggccgccggtcgccgccggcatctcgcgtaccgcagatttgccgcagaagaatcagatccaaaccccgtatcttctcttcttccccctccttccccattgtcccg

SEQ ID NO: 6024 - DNA, 307 bp, Zea mays
  misc_feature: Incyte ID No: 700351101H1
  unsure 221, 304: a, t, c, g, or other
agcatgtgctgctagagtaaccaaggcaaatatgctttctttttcttgcagcactgtggtttatcgtttcggcaaacaatgtgggctgctgagtaagaggacatatctggtgcaccaatcttccatgtgcattagatatgttctcgctgagtaatccacctgtggcaaataaataaagcagtcagttctcagtctgtcatgatttcagggcctgtttggantactcagcgagaacatatctaaaatgagtggtgatgattaatatgtgcagcagtgcaccatcttccagggcatagtatggtcncgc

SEQ ID NO: 6025 - DNA, 129 bp, Zea mays
  misc_feature: Incyte ID No: 700351104H1
ttcatcttttgtttgagaatctatgaagtgtatcatatacgtggcctaaagcaaggtgtgtattttgttattctgaaattgttttgcatctggacaaatactaaatatcccagtggccttttttttttt

SEQ ID NO: 6026 - DNA, 303 bp, Zea mays
  misc_feature: Incyte ID No: 700351105H1
  unsure 270: a, t, c, g, or other
atcaggtctatgtaggcaaagagaaacaaactgttgcagaaatgcttccttatttgagattaggatacatttcagatccagacgaaatgcagtctatactctcttctgaaggagatacatgtccagttagtccatgtacagagcgagctgtacttgatcagcttggtggttacctggaatctcggttggctggttatccaacaacattgaatgaagatgaagctatgttggcagatggcatttggaaccaaagcaggaagttgctactangcttgtgaggttggagaagaagatgcccctgcc

SEQ ID NO: 6027 - DNA, 303 bp, Zea mays
  misc_feature: Incyte ID No: 700351106H1
  unsure 152, 237, 276: a, t, c, g, or other
catcccagcacacaacaagcagcctggtttacggtagctgctagcaaaacaatggagaaccctgctccgagcatcgtagtggccatcgccgcacccgtggcggcggagttcgtgaaactcaccttccgtgccctgtatatgcgccgggctgntcctggcagcagggagatgactgtgccgggaaggccatccgaccagctgggcaggagagtcgtcactgacagccccgtgtacganggccgtggcgccgacgcccgcctcgtggctcgcatacanggagtcaggtcctggtcggtaacgcag

SEQ ID NO: 6028 - DNA, 302 bp, Zea mays
  misc_feature: Incyte ID No: 700351107H1
ggaagatgtaagataccccccgagtagaccatctcagggtggctatggtgcatataacgcatacatttcagctgctaccaggtatgcaactttgggtgcaccaacactgtatgatcatcctggatcagcctatggaagagggtactatggatcctctcaagcagtgggcaagaagatatttgttggtagacttccacaagaagcaaacacggatgacctaagacttactttggcagatttggtcgaatcgtagatgcgtatattccaaaggaccccaaaagaagtggccaccgagttttggg

SEQ ID NO: 6029 - DNA, 301 bp, Zea mays
  misc_feature: Incyte ID No: 700351108H1
gggagagggatcacacagaattctccaaagccatgctgaaacttgtgaatgatcatgatcttgctgttagattgggtgaacaagcacgtgaccatgtggtgcaaaaattctcgaccaagacatttggtgatctcctcaacagctacgtcttgaacatctaccatgagaggatggaatgatctataatactgggtcagccatgccatatgaaaacaatttgttcaatacaaggttttttttgcaccttacgtctaatctgattttgatagacacacataatgacatgacactccattgaagc

SEQ ID NO: 6030 - DNA, 127 bp, Zea mays
  misc_feature: Incyte ID No: 700351110H1
  unsure 9, 53, 55-56, 67, 71, 79, 106: a, t, c, g, or other
ggaggagcncgtggagctcgagcccggcgccttcgtccccgttgacctccgcngnnccaatcccaanggcntcgagttngacaacctctacctcgacatgaatggnatcatccacccatgcttccac

SEQ ID NO: 6031 - DNA, 301 bp, Zea mays
  misc_feature: Incyte ID No: 700351111H1
  unsure 8, 45, 135, 153, 210, 241: a, t, c, g, or other
gggttttnaccaaagcatgctcggtcaagaagagataggcttganatatctgctcgtgaagctgctacacaaatattctatgttcctccccatggcattcagcagtttcttgttgatgctgcttcatcttttggngattccaggcattgtgtngtcgcaagggagataacaaaaatacatgaagagttttggcgtggaactttaggtgangcaaatgaagcttttgcaactcgacaaccanagggagaaataacatgctcatagaggggatttatttcagatgacgagattccatcagagg

SEQ ID NO: 6032 - DNA, 211 bp, Zea mays
  misc_feature: Incyte ID No: 700351112H1
  unsure 4, 12, 15, 17, 22, 28, 36-37, 41-42, 48, 56, 59, 72, 91, 94, 109, 113, 115,: a, t, c, g, or other
ctgntttggagntcncnagggngctcanatcgaagnngcannttgtgnccgggacnctncatgacctgatantggaggcagctgatgctgnaanaaagagtctgtacanagcnanagtctnngtgaagccgtgggaggatttcaagtccgttgtcnagtttcgccttnctggagactctgaatctgancccgagccttctgttgcntctga

SEQ ID NO: 6033 - DNA, 295 bp, Zea mays
  misc_feature: Incyte ID No: 700351114H1
  unsure 6, 45-46, 56, 58, 174, 183, 187, 194, 246, 273, 283: a, t, c, g, or other
caaggngtttgaggagatgtctgagcagtacgtggccgtacacgnngaaggagaanangagaagggcatgctatcgctgtgggaagaggaaatgggagagcaaggagtcgtgccttgtttgcgatgcaaggtattgcggctattgtgtccttaggatgatggggtcaatgccanaagggcgcnagtntgtcaantgcatcggccagccaattcgatgaatccaaaaggtacgaagctggggaaganctccaggacgctttcgcggttgctcanccgttggaantcggcaattctt

SEQ ID NO: 6034 - DNA, 303 bp, Zea mays
  misc_feature: Incyte ID No: 700351116H1
  unsure 8, 20, 80, 87, 153, 156, 158, 225, 238, 247, 256, 264, 274, 280, 282, 287,: a, t, c, g, or other
aggagagntttgagggagangggagctagctagatactgcctactggaggagggcttcctccgacgccggacatgggggnggtgaancacctgtgcctggccaagttcaaggagggcgtcgtggtggacgacgtgctcaagggcatgaccganctngncgccgggatggacacggtcaagtctttcgagtggggccaggacgtgctgaaccaggagatgctgacncagggcttcacgnactcttctngctcacttngcatcagncgccgacctngcggcnanatggnccnganagcnacacgc

SEQ ID NO: 6035 - DNA, 294 bp, Zea mays
  misc_feature: Incyte ID No: 700351119H1
  unsure 241, 257, 264: a, t, c, g, or other
gctagatagcgcgcgctcatcaccaaagccgagagccaagcagccagctaattaagcagccaaattcagtgcgatggcgtcgtccgtcaccagaaccgcatgtctcctcgtgctcacactgttcgtcgtctccgcggcggtgatcttgcccagctccctgtgccatggagcccgcggcgtacgctgggttacgtatcggtttggaccctaaccatcctgcgtgcatcggggcatgcccagntctgggggctctacantcacttncccctatcgcggtggcggcctgtgaaacgc

SEQ ID NO: 6036 - DNA, 297 bp, Zea mays
  misc_feature: Incyte ID No: 700351120H1
atggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcatatgctaacagatcttcggcagaggaggcatggtaatctgcaaggcacct

SEQ ID NO: 6037 - DNA, 287 bp, Zea mays
  misc_feature: Incyte ID No: 700351121H1
  unsure 89, 97, 116, 123, 143, 145, 209-210, 244, 249, 264, 277: a, t, c, g, or other
caagatcctctgcaaggtggtcaatgtagaacttagagctgaaactgattctgatgaagtttatgctcaaattatgctgcaaccacaancagagcanagtgagcccaccagcccanatcctgnaccacctgagcctgaaagangnaacattcattccttctgcaagaccttgactgcttcagatacaagtacccatggtggattctganncatgtccagttggggcaagaatagtggctagagntctcnatggaaatgaatggnattccgtcacacnttcgagggca

SEQ ID NO: 6038 - DNA, 291 bp, Zea mays
  misc_feature: Incyte ID No: 700351122H1
ctgggctctgggtggttttttgatttggttagggttttgtttgtactgatatatggagaggaactgagaccaactgcggtctgcggcactgcgctcgccgccagcctccctagggtttccttccccgtcgaccatcagcgcctccccagatttggacctaagccctcgcggacgtgcgcgccggccgcctggttgccggtagaatccgccctccagccgctgccaacgtcgatctgctactgacgcaccgcaaggagctccataattcatattgttcattatcctcattgc

SEQ ID NO: 6039 - DNA, 296 bp, Zea mays
  misc_feature: Incyte ID No: 700351123H1
  unsure 197: a, t, c, g, or other
ctcggatcagatctccaccgggcgcaaggctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaaatcaacagatccgaaggattngcgattgaagcttcagaggcgaattttcaacaagattttaccagcacaagaagttctggtgtgcgtgatctacgtgagaagctatctggtataatgaac

SEQ ID NO: 6040 - DNA, 296 bp, Zea mays
  misc_feature: Incyte ID No: 700351125H1
cttacggctgctgatgccagcgggggtgtgacggtgaaactctgcgacggggctggatcgtcttgcgagcgctgggtgttccgcaacgacggcaccatcttcaacaccggcaccgggatggtcttggacgccaggccatctgcgggggctaatgctactgctagccaagtcatcgtgtcgcccgccactgggagtcccacccagcagtggacgctcatgctgtgatctcatctacggctcatgagtcatgactgtgggggcagggcagtatgcactgcaacagtagctggtgtgtt

SEQ ID NO: 6041 - DNA, 294 bp, Zea mays
  misc_feature: Incyte ID No: 700351128H1
  unsure 34, 45-46, 155-173, 215, 232, 289: a, t, c, g, or other
tcacatccttcatattgaaggtgactcatttttntgcacactttnntgatgtgatgcttgacgtgaggcccgacactaggattctcaatgcaagaatccagtaccttgcacatagaagtagcaacccatcccttgcctattttcatcttgctgtnnnnnnnnnnnnnnnnnnntggatgtgacttgttttgaatgttttgtattatacttgtttntgtgtgtgcataaatgncatctgtaggatctaagaaaaagagtcccagaatgttgctctattattgtgcacaancatgg

SEQ ID NO: 6042 - DNA, 293 bp, Zea mays
  misc_feature: Incyte ID No: 700351129H1
  unsure 2, 4-6, 8, 10, 66, 73, 82-83, 88, 99, 103, 123, 152, 159, 165, 170, 230-231: a, t, c, g, or other
ancnnnanantaaagctctgtcagtttctagggaagaagacattcttgctgaggatgtctaagcanatctganagaagagcnnaggancgttatactcncaanctggctgaggaaaacttganagcgatacgtgctttctcttctaagcttntggaagnacttgntctanattctgatgtcttcgaatgatgctattggattattgcagcctgcgataagtgagatagcnntccatatcagacaaaaacgttgttgggaattctcctgatgcaataagaaagttgttggatgc

SEQ ID NO: 6043 - DNA, 298 bp, Zea mays
  misc_feature: Incyte ID No: 700351131H1
ctccttcttctccggttctcgctcgtgcccttctctcctggcggcgacggctgggcgagcggcgcggcccgttatcacttcccaggtcttcggcggcgacgagtttccaccaggctgaccggaacgcagtgcgtggagaaccggtgagcagctgcagccatgtccgtggcggccggcgtgaggacgcgggccatcgcggtgcgcgacaagctccgtggaaagattggtcagaccaaggtcaaacggtatggccggggaaggcgcctgagtgggccgatgacgtcgatgaggacgtcgc

SEQ ID NO: 6044 - DNA, 301 bp, Zea mays
  misc_feature: Incyte ID No: 700351132H1
  unsure 2, 16, 20, 32, 38, 73, 78, 84, 86-87, 92, 94-95, 99, 103, 152, 159, 174,: a, t, c, g, or other
gncaagctgagcttantggnggcgagctgganaagaangaaggagcatggccatgccggcggcgctgcttctncttcntcctantnntctcngnnttcnaggncggggagcttccacgctgctcggatgctgctgcaggtaaaccggcagtnctcgtcncatgatgattgagtncggttcaagacacncagccncatcgcaacagtgcccttccangancncgtcgccgacatcatcaacggtgacttcaaggantccaccatcaccancnntcctgnaacanntgnncagancataaggc

SEQ ID NO: 6045 - DNA, 292 bp, Zea mays
  misc_feature: Incyte ID No: 700351134H1
catctgtgtactttgtggcaaattgccttattgatatgtactcgaagtgtggtgatgttgatactgctagaaatgtatttgatagcatgcctaaaaggaatgaagtatcttggacttcaatgatgtcagggtatggaatgcatggtcgtggtaaggaggctttagacatatttgacacgatgcagaaggcaggctttgttcctgatgatatttccttcctggttcttctttacgcttgtagccattctggcaggtggatcaaggtctgaattactttgatatcatgcgcagg

SEQ ID NO: 6046 - DNA, 294 bp, Zea mays
  misc_feature: Incyte ID No: 700351135H1
  unsure 206: a, t, c, g, or other
ctcggttgctgagaagtataaaaagagtccatacaggcaagtgtcagcttagctaattacagaccttacgaaaatgtgtctgcttcgtcactttcaaaagaaaggaaaaaggtcaagagtttaaccgatacagtagtttcctttagtgccatgaaaaaggaacagtaatattggcattcaacagtaacaggtgtgtattttaaatnctaacatatagaggtaaaacaagatgcagggtaaccttgcgtgaacaaatatttaggttgatatttaaaaccataaactttacagcat

SEQ ID NO: 6047 - DNA, 290 bp, Zea mays
  misc_feature: Incyte ID No: 700351137H1
  unsure 99: a, t, c, g, or other
ttgggaaggacaagcttgtcgtatcaacttcctgctcgctcatgcacaccgctgtggatcttgtgaacgagactaagcttgacagcgagattaagtctnggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccatgaagaagtccagaaggctgctgctgctctcaagggtctgaccaccgccgtgggac

SEQ ID NO: 6048 - DNA, 288 bp, Zea mays
  misc_feature: Incyte ID No: 700351139H1
  unsure 72, 100, 111, 114, 122, 133, 139, 142, 144, 238, 281-282: a, t, c, g, or other
ggggagctgctccatggcaagaaaggtggccatctccactgggacactcgctacaagatcgccgtgcgaggncgccaaggggctcagctacctgcaccangattgctcgcngcngatcctgnaccgcgatgtnaaatcnaanancatcctgcttgattccgatttcgaagcacacgttgctgatttcgggctcgccaagttcttgcaggactctggcgcatcacagtgtatgtctgcnattgctggctcctatggcatattgccccagagtacgcatacannctcaag

SEQ ID NO: 6049 - DNA, 288 bp, Zea mays
  misc_feature: Incyte ID No: 700351142H1
  unsure 114, 122, 218, 269, 283: a, t, c, g, or other
gggctcctcccaacccaaacgacaaaaccctagcctcctcttccgtgttatgggatgccgtctaaaccctatccccactccctgacctcctctacttcctccgccgccgtggcncccgtcanctggatgtccgcatctgcatggacggcgcccgagtcctgatcgccgctagtgccaccgccgtctgctgcctcgcctgcgctgtctggatcttccgntcctcttcctctcgttccccgcatcctcaaataagcaccaacccctcccgncaattctgcggtgngttcc

SEQ ID NO: 6050 - DNA, 284 bp, Zea mays
  misc_feature: Incyte ID No: 700351144H1
  unsure 90: a, t, c, g, or other
ggagcatgtccgggagcagcaggcccaagtcgagaaagaagacttcagtgacatggtggcggagcatggctgccaaacagaagcaaaagnaacggaaagctcagccccaggacagtcgtgggggcagcaagaaatacaaggagttcaaattttaggtccttctcacatacctggccttcctttaggccctttgtatgtctgggctttctatgtgggttcctgaagctagttctgtactccctaggcttgtcacttcctgttcttatttagacttgttttgtaaa

SEQ ID NO: 6051 - DNA, 291 bp, Zea mays
  misc_feature: Incyte ID No: 700351145H1
  unsure 109: a, t, c, g, or other
attgatgccaggaattaggcccccgattttaccagctccaggttatcctggtcctccaccaaccatgcagcaaccaggcgccccacctgggtccatgccacaaccgggngctccacctggttccatgccacaaccaggcgctccacctggttccatgccaatgcagatggccccactcccaaggcctccaacgctaccgcctccaacatctggagtcccaggtgctcccattctaacagtggagcacctccagccatttaccaagcaaatccacaagcatctgcaggtcca

SEQ ID NO: 6052 - DNA, 290 bp, Zea mays
  misc_feature: Incyte ID No: 700351146H1
  unsure 52, 55, 67, 73, 91, 116, 137, 160-161, 166, 208, 225, 227, 287: a, t, c, g, or other
ggcgtcttctccggcttccattttcgcgaggaggcgaggaggacagagacgncgncgccgcttccgnttcganctcgacctcggcttcggnttccacgagaattctagcaagtctnctggagaatataatccacatntgtttattttgctgcattttggnntggangaatctgcctgtagatccactgccccagttgggtttcttagnagaggttcgggcattcntngagaaatcaaagcatgaggataggtcaaatcagtacacaagcagccagggaagagttcanatc

SEQ ID NO: 6053 - DNA, 292 bp, Zea mays
  misc_feature: Incyte ID No: 700351148H1
  unsure 10, 18, 74: a, t, c, g, or other
gccgcctgcnggcccgcnccggtgaggctccgtctgatcttcgaaaacagccgtctcctccgacgtgtgcaganggatgaaggccttcggcgctgctggcttctccttagcccagagctcgccaccgtcgccaacctcgctgctcatgtcgcagcccgtttccgccttcgccgcactgcccacgcggcgttgtgctctcaatggatgggtttaccttgccaccatttgagtcaacctgcatctttagggacaacgatattataagggttaaacaaaaatcctgtacgaagca

SEQ ID NO: 6054 - DNA, 321 bp, Zea mays
  misc_feature: Incyte ID No: 700351149H1
  unsure 2, 20, 30, 33-34, 38-40, 42, 47, 56, 72, 83, 102, 109, 131-134, 138, 153,: a, t, c, g, or other
gnctcgccacttcgtaccgncaccgtctcncgnncgcnnngncggcnacctccgcntcgcatcgctcgagcngacgatcgttncgagatttgttgatcaaanaaccatngaaggatcgttccagttgaatnnnnacgncagtgcctttcatanctggattgntggtttcatctgcacaaaaagccccagaaaancaangaggatcatcatnaaagggagaancttcnggtagcaccttgattcttctgggtatgagganaatgactngatgnactngtctngtcaaatggtcttttcaagttccaaaaagnttccacggat

SEQ ID NO: 6055 - DNA, 310 bp, Zea mays
  misc_feature: Incyte ID No: 700351150H1
  unsure 245, 307: a, t, c, g, or other
gggaaacatctcttccatatgcctctgcagaggatgatgccagtatcatcaagggaacaggtgttgttgaacctattgatacagaagaagctccacagattccaatcctccagagtgatgaagatgttgtagaggtaaagaatgaaccttcttggcatcttaaggcattaaactgccaatgtggctagtagggccttcaatcctgttggttacgggtatagttccaactttatggctcccatgtnttcagtgttcaggtcccaacatcgctggcctctatctctagtcggattgactcattttaagnggg

SEQ ID NO: 6056 - DNA, 317 bp, Zea mays
  misc_feature: Incyte ID No: 700351151H1
  unsure 164-165, 181, 196, 277, 305: a, t, c, g, or other
aattcagcaaacaagcaaaggtacggccaccaccaccggccaggaagcaagctcaaaccctaaccgccggcgacgccagcacgatggcccgctacgaccgcgcgatcaccgtcttctcccccgacggccacctcttccaggtcgagtacgccctggaggccgtnngcaaggcaacgccgcngtcggcgtccgcggnacggacaccgtcgtcctcggtgtggagaagaagtcaacccccaagctccaggactccaggtccgtgcgcaagatcgcgtgnctggacacccacatcgctctggcatgcncggggctgaagc

SEQ ID NO: 6057 - DNA, 316 bp, Zea mays
  misc_feature: Incyte ID No: 700351152H1
  unsure 45, 132, 142, 167, 172, 174, 193, 205, 217, 226, 258: a, t, c, g, or other
cagcgtatcatcgttttccatcgctcctactcctatcatccaganaatctgagcggtattgatggcgcccaaggcggagaagaagccggcggcgaagaaggtggcggaggaggagccctcggagaaggcggntccggcgganaaggcccccgcggggaagaagcccnaggcngngaagcggctaactgcgggnaagtccgccggnaatgagggcggngacaagaanggtaggaagaaggcgaagaagagcgtggaganctacaagatctacatcttcaaggtctgaagcaggtgcaccccgaaattggcatctctt

SEQ ID NO: 6058 - DNA, 116 bp, Zea mays
  misc_feature: Incyte ID No: 700351153H1
  unsure 6, 8, 27, 32, 40-41, 47-48, 51, 79, 88, 94, 97: a, t, c, g, or other
tcgcgngnagtgtctagagcgactggntcagncgcttggnngggctnnagncgcagtcgcactcgagcggacttgaaanaggtagaanacggcnagnctacgtggataccgagcac

SEQ ID NO: 6059 - DNA, 315 bp, Zea mays
  misc_feature: Incyte ID No: 700351155H1
  unsure 2, 41, 70, 94, 107, 110, 136, 141, 146, 152, 225, 237, 280, 288, 294,: a, t, c, g, or other
gngtagccccaccagcaggcggccccctcttactccacgancgccaccgtcttctggccgtacgcgactncgccgcagaaagagagccgagganggcagcgacctcncgntggcgtcggatatggatctcgacgcngtagngcagncccggnagataagctgaaagcagtgtcagaggaacttggacatgagatccgggttttttcaagtgagaactttgctctncaaccgagcaanctgcctagtgcagatcatgaggaaagtgagacttttatgaggntcaccctnctaagncanncnaactggnntcaaacg

SEQ ID NO: 6060 - DNA, 53 bp, Zea mays
  misc_feature: Incyte ID No: 700351156H1
  unsure 14, 28, 30, 33, 39-40: a, t, c, g, or other
gtcaactccacttntcttctccgcgtcncntcntcttcnncgccgccgacgct

SEQ ID NO: 6061 - DNA, 315 bp, Zea mays
  misc_feature: Incyte ID No: 700351157H1
  unsure 5, 61, 76, 83, 88, 100, 109, 115, 121, 123, 158, 184, 187, 192, 212, 223,: a, t, c, g, or other
aggangtggtcgacagctccctcgaattcctcatccttgctagcgacggactctgggatgntgtcactaatgaggnagctgtnggcanggtcgagtctanccaggatcnccaggnagcagnanacaagcttctcgaagaagcttcccgaagggtagcnccgataacatcacagttatcatcgtncgnttcanagacggaactaccggtgagnaatcaggcgangacaaagngagcancaangaccaagnctcctagctgtctcgtgtagggatcnatcgngntgtgtgttcttctggctgntgnnggaaaggtaa

SEQ ID NO: 6062 - DNA, 308 bp, Zea mays
  misc_feature: Incyte ID No: 700351158H1
  unsure 38, 55, 59, 77-78, 88, 94, 107, 109-110, 117, 123, 125-126, 146, 151, 179,: a, t, c, g, or other
cttccttccctgtgctgttcactagatgcctatcctgnatttgatgagatcttcnatgnactcacatcctgtttgtnntctccttgtngtagcntagcttgtgccancnntttatancccatnanntcttaccaacagcgacttcnaaggnggtttcaatatcaggattggaatttctngcataagngcctttggntgtaaattagatggannctgntgcagtcaatacagngaaaacttgtangccatgtgacatcttanaacattaaaaggtttngcncanaaacattggncnttgtttatgaggg

SEQ ID NO: 6063 - DNA, 309 bp, Zea mays
  misc_feature: Incyte ID No: 700351160H1
  unsure 85, 138, 212, 222, 236, 254, 256-257, 267, 271, 298, 308: a, t, c, g, or other
caaaagagcccgcctctctagtaggcgtaagatgtcccatcctcaaagctgaaaatataacatgccaaaattgtctagcgaaacngcaagagcacaagaggtgcaagatagtttcttgctcttgatcacataatgganagaccaccgggtgcggtagtcctttcctctgaagtctatccacagtccaacatttattccttatcgccagccanacaaaaaatntgcattggggggtnccacgacttccagacccntnnctgtacgganaganatagctcccataaacaacgccgataanaagattggang

SEQ ID NO: 6064 - DNA, 299 bp, Zea mays
  misc_feature: Incyte ID No: 700351163H1
  unsure 276: a, t, c, g, or other
gcaacgcaaaaacaagcacaaacacgcgcgatccgatctgggccggccaagcagccacccatccatggcgactagggtttggctcaccgccctcctgcttggtttcctcgtcgccgcctcccccttcaccagccgagttgctagagctgaatccgaggaagatgctgctgcagctgaggttgttgaaggggctgatctaggtattgtgggtgatgatacacaggtttccagtgatggacctttaagtcctgctcctggtgtagagacatagttgtnttcccaaaaaatgctggcaaaat

SEQ ID NO: 6065 - DNA, 307 bp, Zea mays
  misc_feature: Incyte ID No: 700351164H1
  unsure 88, 172-173, 177, 179, 182, 212, 254, 261-262, 267, 296: a, t, c, g, or other
gtgagagatatgaactccatcacaaactgcgatacacagatgatgctttaattgctgctgcacagctgtcttatcagtatatcagtgnatcgtttcctgcctgacaaggccattgacttgattgatgaagctggatcccgtgttaggctgaggctgcccagctccctgatgnngccnanccncggacaaagagtgcgacagataaccaagcngaaaaacgaggctgtacgcggccaggatttgagaaggtggtnattaagnnaccgngaatggaactgaaggctcaaattcggccntattgacaagg

SEQ ID NO: 6066 - DNA, 312 bp, Zea mays
  misc_feature: Incyte ID No: 700351165H1
  unsure 2, 31, 38, 40, 46, 48, 50, 62, 81, 98, 115, 137, 311: a, t, c, g, or other
cntacctccgcgctcccgcccagctagggtntccccgntntccccncntnctcaaccgccgncgtcgccgagagcggcganacgatgttggagctgcngcttgtgcaggggagcntcctcaagaaggtcctggaggngatccgcgagctggtcaacgacgccaacttcgactgctccggcaccgggttctcgctgcaggccatggactcgagccacgtcgccctcgtcgcgctgctcctacgcgccgaggggttcgagcactaccgctgcgaccgcaacctctccatgggcatgaactcaacaacatggcna

SEQ ID NO: 6067 - DNA, 307 bp, Zea mays
  misc_feature: Incyte ID No: 700351166H1
attcagtaagcctcggagctgcagcgactgtttgcggtgtgattatcggatcaatggcagttgcacaaatcttctcctcggtatatttcagtgcctggtcgaacagatcgtacttcagacccctcgtatttagctgcatcatgttgtttctggggaacctattgtatgctttggcatacgatctgaattccctaactgttcttatgctggccggctactgtgcggtttgggttcggccagagccgtgaaccgccgctacatcagcgactgtgtacccctgaaaaccaggtgcaggcgtcggctgggg

SEQ ID NO: 6068 - DNA, 305 bp, Zea mays
  misc_feature: Incyte ID No: 700351169H1
  unsure 5, 11, 34, 39, 59, 70, 95, 100, 117, 132, 149, 151, 155, 165, 183, 190,: a, t, c, g, or other
ctggnaaccgngtatctggttcagcctcttgggngggcngaagacgaagagcactcgancgactttgaancggaagaaaacggtgacggtgccgncgatnaggagatcgatgaagangacgatgacggtgangactctgtggaggcgcngnctcnacgaagacgnagaagtcagcgacgaagnagtagangacgacgacgatggggatgatgatggngacnangatgacgatgggaggccaccatccaagcgttaatatngttagctctanttttgtagctgtgtccttgggtgtttggtaagta

SEQ ID NO: 6069 - DNA, 255 bp, Zea mays
  misc_feature: Incyte ID No: 700351171H1
  unsure 9, 14, 18, 21, 26, 29, 39, 45, 57, 100-101, 122, 129, 134, 152, 160, 178,: a, t, c, g, or other
accaaccanagggnaggnggnaagangangaggattggnttctcntctacccttgcntccttgttccttgtaggttcccctaatctagctaacgaccgcnnagctttcaggtagagatcaanacgatcnggaanattcacgatttatccggnatcatatntcgtttttccttagaccnttncgcanttncgggnanaaaacgggaacatngcatgcnacgatatagtanttatggncgacgaggangatctacng

SEQ ID NO: 6070 - DNA, 306 bp, Zea mays
  misc_feature: Incyte ID No: 700351173H1
  unsure 99, 158, 178, 243, 263, 271, 284, 293-294: a, t, c, g, or other
tcctcgtcctaaaaaaccctaaccccaactccccacactcgtctcgccgggggcggcgcgatggagggctatcaccggcggcgtcgtctcctgccagcnctgtcccctccacaaggccgccctcttcctcaaacgcttcaccgagtctgccgcctccnacctaccctcctccgactgntgtaactacctccgcaacgccgccgacgccacaacacagctcagccgcttccgcaagaactcggnggcagcacaagcagggtgcngccaactngatgcccactacnatgatgatnnggtccaggggca

SEQ ID NO: 6071 - DNA, 305 bp, Zea mays
  misc_feature: Incyte ID No: 700351177H1
  unsure 9, 14, 18, 20, 23-24, 26-28, 137, 139, 162, 183-184, 198, 221, 239, 255,: a, t, c, g, or other
caagggtcntagcngtcnanctnntnnncaaggatgacatccgtatactgagagatatagagcacttactacagcacacaaattgacgagatgccaatgaatgttgctgatcttatttgagcagcaagaggatccgnangggagcttcttgtgttggctgangcccttggcgctagtgtggcnnctggactggagcanatgggcttgtaagttgggggtanagcagagattatttccgnttttgccatggcatgnactgnntatattttactcgctccagctcatgtaacactttgttgcngcgg

SEQ ID NO: 6072 - DNA, 306 bp, Zea mays
  misc_feature: Incyte ID No: 700351180H1
  unsure 43, 277, 279-280, 282, 285, 292: a, t, c, g, or other
ctctcccttccggttccttcatctccgcctccacggctccacntccaccgctgctccacacgggcacacctttgcctcgcccaaccgctgccttgctcgcgttcgccattccccagaccttgagagctaccgtctggtccgatcggacggatcccttcgcgcgccccagagatttcaggtaaggtgctgtaacagaagatgcaagggggaagaggtgggaggcagggcttattcggtttcggggaccttctggtggttccggtggctttagactagnanntnagnttacggnagtaaaagtggcgc

SEQ ID NO: 6073 - DNA, 305 bp, Zea mays
  misc_feature: Incyte ID No: 700351181H1
caaggcttctgtcactagtgcagaagtaagccaggatggcaggttcatcactactgctgatggctcaagtgtaaaattctgggacgcgaatcactttggccttgttaaaagctatgatatgccatgcaatgtggaatcggcttcacttgaacctaagtctgggagtaaatttgtcgctggaggagaagatttatgggttcatgtatttgatttcttcactggtgaagaaatagcttgtaacaaaggacatcaggtccagtccactgtgtccggtttgcaccttgtggtgaatcatacgcatcggg

SEQ ID NO: 6074 - DNA, 315 bp, Zea mays
  misc_feature: Incyte ID No: 700351187H1
  unsure 164, 223, 260, 293, 307: a, t, c, g, or other
agcatggtaaaaaggttgtgtgtggaactccaagtggagcgctcttattatattcatggggatactttaatgattgcagtgaccgctttctcggacacacgcagtctgtggatacaatgctgaagctggatgaagacactttggtttctggatcatcagatggngtgatcagattagtgggcatcctacctaataggataaaacagccacttgctgaacattnagaataccccatgaggcccttgctttgtcaaacgacnagaaatatttaaggcagcatctcacatgataanatgctgaagctctnggacatgg

SEQ ID NO: 6075 - DNA, 314 bp, Zea mays
  misc_feature: Incyte ID No: 700351188H1
  unsure 2, 117, 141, 185, 222, 246, 249, 273, 280, 290-291, 299, 306-307, 311: a, t, c, g, or other
angaagtggtcgacagctccctcgaattcctcatccttgctagcgacggactctgggatgttgtcactaatgaggtagctgttgccatggtcaagcctatccaggacccccaggaancagcaaacaagcttctcgaagaancttcccgaaggggaagctccgataacatcacagttatcatcgtncgcttcatagacggaactaccggtgagaaatcaggcnacgacaaagagaccacgaacgacnaanatcctagtgtctcgtgtacggatnaatcgtnctgtgtgttnnactggctnttgtaanntgangtc

SEQ ID NO: 6076 - DNA, 300 bp, Zea mays
  misc_feature: Incyte ID No: 700351192H1
  unsure 71: a, t, c, g, or other
aagaagggaagagttctcggcttctcgcgagtcgcgacagagagaggcggagttgcggagaatatgcagancagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatatggatccgccctcaacatccgcaaggatctcgatgcccaaatcctctccagttccaaaggcccc

SEQ ID NO: 6077 - DNA, 306 bp, Zea mays
  misc_feature: Incyte ID No: 700351195H1
  unsure 202, 286, 292: a, t, c, g, or other
caccgctctcgacattgctgccgaagagaggcaccggatggtttcctgccttctgaatgtgactgtccaagagagtgacgagccaatcacactggggtatagtgtaaggctgtcatccggagaggttgtggatgtgaagtccagccgaatggtcaggtgggagagggaggattctaaagctgtacgtgcagagtggcgacgncgagcccagctacaaagagaagatcgagttcgcgacatattcgcagaggagatctttcagggcctgcttcttgagatggcggantagatnccctccctcgctgg

SEQ ID NO: 6078 - DNA, 301 bp, Zea mays
  misc_feature: Incyte ID No: 700351196H1
  unsure 2: a, t, c, g, or other
gnaaaaaatcgaaatcgtttgaggaggtctacatcttctcctgagactggattgaacgcctgagtgtcttcaggaatctgtagttctgcactacattgctattgtagtgtaaccgtgcattagtattacccgtggtaccagaagttgtatttgtatagattcgttggactgcctgtattgcagtaacctttccaccgtatgggtggctctatagaatgcctataagcagcgcaataataatgataatgtaagactgaaaaaaaatactgtatggagatttcctgaatttaaaagtttctcc

SEQ ID NO: 6079 - DNA, 303 bp, Zea mays
  misc_feature: Incyte ID No: 700351201H1
  unsure 198, 246, 255, 257, 264, 266, 268, 273, 276, 297: a, t, c, g, or other
aaggaactgttgcctgcaataatcaatgttatgattggaatcatagttaagaagtctaacgaggacttgaagcacctgaaaggaataacagcgacatataggatgacgagtaaacttccagtcaggcatctccatatgtatcagggatttacatccgttgaaggtgttcttgaaggggaccgtatacgctatctatcngaagatggtaaaactaagttgtgtcgtggggctacaggttaggatacngcaattacnangacttgncncngaaantgncactgtggcaaggaaaccggnccttcc

SEQ ID NO: 6080 - DNA, 301 bp, Zea mays
  misc_feature: Incyte ID No: 700351202H1
  unsure 39, 273: a, t, c, g, or other
agcctttggaatggaatacttgcatagcaaaaacattgngcactttgacttgaaaagtgacaatttgcttgttaatttaagggaccctcagcgtccaatatgcaaggttggtgatcttgggctttcaaaagtgaagtgtcagaccctcatctctggaggtgtccgaggaacacttccatggatggccccagaacttctgaatggtagcagcagcttggtctcagaaaaggttgatgtattctctttggggatgttcctgggaactgctaacangagaagagccatatgcagattacattat

SEQ ID NO: 6081 - DNA, 299 bp, Zea mays
  misc_feature: Incyte ID No: 700351204H1
  unsure 2, 38, 60, 97, 108-109, 124, 130, 165-188, 195, 197-198, 213, 216, 223,: a, t, c, g, or other
cncagagccgagcctacagtccaacaagaggagggganaactcgtcgcgccgcctccgcntccgcctccggtggttagttcctctctcctcgtcagntcaccgcccgnnccacagaactctgcnccgtgntttgccaccggtgactgcagaagcagctagccatnnnnnnnnnnnnnnnnnnnnnnnncttcgangnntacaccgacaagaangcnatcttcngcngcctcaaggcnaagnccgagaacangatgtgcttcgactgcaacgccaagaaccccattggtgcttcgtcagc

SEQ ID NO: 6082 - DNA, 293 bp, Zea mays
  misc_feature: Incyte ID No: 700351205H1
gaatgacacatgcaggaatgaattttcacgagctactggatatcccccagggtgatcgtcggaaataccatgatgatgtttctgttatggtaatctcacttgaaggaagaatctggcgatcttctggatgagtgttgaaacatgacctggtctgttccttgcagccttgcttagtgtagtaaatcgactcaatcaggaaaggcaccaatgtcttgctgtcttattttcaaccatgttcaaattctggcaatccatgtgcctctctgtctatacgtttggattgcgctgcatct

SEQ ID NO: 6083 - DNA, 301 bp, Zea mays
  misc_feature: Incyte ID No: 700351206H1
  unsure 97, 115: a, t, c, g, or other
cctcgtaccatttcgatccaatggcgccgacgtcgaagctgtcgacgggcatcaagcgcgcttcgcggtcgcacgcgtaccatcgccgtgggctgtnggccatcaaggccaagancggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagatggtg

SEQ ID NO: 6084 - DNA, 294 bp, Zea mays
  misc_feature: Incyte ID No: 700351207H1
  unsure 104-105, 108, 114-116, 185, 279, 287: a, t, c, g, or other
gcttttctctaatggtgtatctgttgagcaactaccggatcttgagctcaggtttgagcagttctctcctgaccacatctccaataccgctattgcttccacannacntacgannngctcatctgcttcagtgcccttattggaggatcacaggacctgatttcagaattggagtctctggcgcncatgttaattgaatctaggaggatctgcaggacaaaggcataatgctcccttttttcaatttcaggggttagatttttttttggatgaaggcangattatgnccattgg

SEQ ID NO: 6085 - DNA, 297 bp, Zea mays
  misc_feature: Incyte ID No: 700351208H1
  unsure 75, 140-164: a, t, c, g, or other
gttaatgttccaccgttcgggtgtgctgattgttaaggcacagatctgggacaccgcaggccaggaaatatgacnagagacgggcgttgacagctaaacactccgtctgttgaatgttgatcccttcaacatttcccctnnnnnnnnnnnnnnnnnnnnnnnnnaccaatcgaatcaactgcacctcttgaccgcttctactccaccgcctgctgctccgctagtctcttcaaccttgtgatgctcagccccccgcccctggtatgatcgctcagcacaaagcgtcgtacttggata

SEQ ID NO: 6086 - DNA, 287 bp, Zea mays
  misc_feature: Incyte ID No: 700351209H1
  unsure 2, 6, 18, 20, 25, 40, 51, 59, 62, 71, 86, 92, 94, 100, 130, 141, 158, 162,: a, t, c, g, or other
tngaancggatgtttatnantgcanatttgttcagtctgngataactgacntgccattnttngcattcaanagtccagttgtgcancaatgntnttgagnccgtcatttctgccgacctccagggaatgnctaagtatgangccaaggcacttgaggngctnaangncgagtnganggcaagcnttaagaaggntnttncttcgtgaacaaacagcgggaagcggctncaatctgtgtnaggcgaacaagtgnancagaggaacaatcgtcttnaaaggctttannt

SEQ ID NO: 6087 - DNA, 294 bp, Zea mays
  misc_feature: Incyte ID No: 700351215H1
gtataaagaagagaaagctaccagggcttacaatttagctgctctcaagtactggggaaccacaacgactacaagttttccagtatttgcatatatttcagttcacttctcaagaattatactttttttcctttatcactgcttcctttggatattatacgatttatttttcatgctagatcagcaactatgagaaggacctggaagagatgaataatatgtgacgacaagaatatgttgcgtcacttagaaggaagcgcggtcaaaatcaagattcaggaaaagcgtggattt

SEQ ID NO: 6088 - DNA, 299 bp, Zea mays
  misc_feature: Incyte ID No: 700351217H1
  unsure 34: a, t, c, g, or other
cgcgctttgcaacgcctccgctgcaatcagcccncgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgattatcggtccaacggtgacgccggctccgtcgctttcgtcgtggtatc

SEQ ID NO: 6089 - DNA, 120 bp, Zea mays
  misc_feature: Incyte ID No: 700351218H1
  unsure 12, 17, 22, 27, 54, 65, 69, 84, 90, 94, 100, 109, 114: a, t, c, g, or other
tagctagcatgnacgcngttcnccaanctctggcgtagtcttgttcatcttcgntctcctccatntccnttcatcctctctctngctgtntgangagaantgcctgacnctgcnccctct

SEQ ID NO: 6090 - DNA, 296 bp, Zea mays
  misc_feature: Incyte ID No: 700351221H1
  unsure 44: a, t, c, g, or other
ctcccagaagtcacgcaccaaacaccaccaccaaagaaggcganaacgctccccttcccctccagtctccaggaccgtctcctcgcctgctcatctaccgctgctccccttctctgggctcggagaatcggagagaagcgcgcgcgaccatggcgtccagcgcctctcggttcatcaagtgcgtcacggtcggcgacggtgccgtgggcaagacatgtatgctcatctgctacaccagcaacaagttccccatgactacatacctacggtgttcgacaattcagtgcaaatgtagt

SEQ ID NO: 6091 - DNA, 298 bp, Zea mays
  misc_feature: Incyte ID No: 700351222H1
aaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgtggactacatcattctctggccctgtggtggccatggtctgggagggcaagagcgtcgtcacaactg

SEQ ID NO: 6092 - DNA, 297 bp, Zea mays
  misc_feature: Incyte ID No: 700351223H1
  unsure 56, 110, 227: a, t, c, g, or other
ctcgaagcttgcgttcttgtagtagaggtcggcagcaagcggtggtagagcgagangtcgagaagatgaagagcagcactctgttggcgatcctagttctccaggcccgntctggtctctgcggccgtggccaaaggacctgcagggccgacgacgaagaagcagtgctggtgcggcgagtgcaccagctggttcgggcgtgtggacctgcgacgacctccttcacnaagtgcgccgccacctgcaagaactgcgtccccgtgttccacggacaagggggccatcaagtacagtgcc

SEQ ID NO: 6093 - DNA, 293 bp, Zea mays
  misc_feature: Incyte ID No: 700351225H1
ccggatgtttatgagtgcacatttgttcagtctgagataactgacctgccattcttcgcatcaagagtcaagttgggcaagaatggtgttgagtccgtcatttctgccgacctccagggaatgactgagtatgaggccaaggcacttgaggcgctgaaggccgagttgaaggcaagcattgagaagggtattgctttcgtgaacaaacagcgggaagctgctgcatctgtttgaggcgaacaagtgaaacagaaggaacaatcgtcttgaatggctttaagttttgcagccta

SEQ ID NO: 6094 - DNA, 295 bp, Zea mays
  misc_feature: Incyte ID No: 700351226H1
  unsure 125: a, t, c, g, or other
tgtagatacacctagaacaaggccttcagatgctcaagatatttagggagcatgtcagcaagacgtccatcttggatgacttcgccttctatgagagtcgccagaagctgatgcaggataagagntcgaaacagcagcaggtccaaaagcaggtctgggacagtaggacccccatttctgtcactggaagcgagcaacagcaggaagctgctaatgggaagcccaatccgtctgtaccaaacggtgtccctgcagaggtgaaggcggcgaaggcttctgcagagaacggcaccgc

SEQ ID NO: 6095 - DNA, 288 bp, Zea mays
  misc_feature: Incyte ID No: 700351228H1
gaacgcaagcagtgattattacatcgtggccagtgctaggtttgtgaacgaatcgctttggaccagagtcaccggtgttgcaattttgcaatattcaaattcaaagggaaaagcatctggtcctcttcctgatccaccaaatgatgagtatgacaaaactttttcaatgaaccaggcacgttccatcaggatgaacgtgagcactggtgctgctcgtccgaatcctcaaggatcattcatatgggtctatcaatgtgagccaagtttacaagctgaggatgaacccac

SEQ ID NO: 6096 - DNA, 60 bp, Zea mays
  misc_feature: Incyte ID No: 700351229H1
  unsure 5, 12, 21-22, 26, 30, 52: a, t, c, g, or other
gtcanagtcacnattcgcttnnatcnacangggttggtttcagtcgaatctnccgttttg

SEQ ID NO: 6097 - DNA, 292 bp, Zea mays
  misc_feature: Incyte ID No: 700351231H1
  unsure 142-143, 150, 154, 262, 289: a, t, c, g, or other
ccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagnngtccaantcgnaccagtacgagactacgtcgctggtgcagatcgagggggtgaacaccaaggaggacgtcgcgtggtatgcgggaagcggatggcctacatctacaaggccaagacctngagcagcggcacccactaccgtgcatnttg

SEQ ID NO: 6098 - DNA, 296 bp, Zea mays
  misc_feature: Incyte ID No: 700351232H1
  unsure 23, 31-32, 40-41, 49, 60, 66, 68, 88, 91, 101, 108-109, 115, 121-122, 144,: a, t, c, g, or other
cccagacgtagtttcagctagcngcttctanntccctctnnccccccgnctgcgcgctgncgcgananctgcgttcctgatggggaantgngccggcgtgnagggganngccganatcaanncttccttcagtgcccccaattnctcagggacngccggttctaagagngtnagnanaacgcggngacaccagcacttcggcaccaagactccggnttcgtcgtcgtcggtgccgncaacncntcgtacngaagcggagatctggagtcgtcgaatgtccgcaaattcaggtgggg

SEQ ID NO: 6099 - DNA, 225 bp, Zea mays
  misc_feature: Incyte ID No: 700351234H1
  unsure 2, 141, 147, 173, 202, 212, 224: a, t, c, g, or other
angaagcttgataggaaatggaagcagagcattgtggtcagaccaccaccatctctaagggggaacaaagaggagtagaaagccgcaaaaagagggcaatgtgcaaaagtcgtttcatgcgagtgttgcaggaaggtcccntcatgntttcaacccttattgcgttggtatgnattccatgtttacatttgctaagcatgcnatctgaatcngaattcagttgnt

SEQ ID NO: 6100 - DNA, 288 bp, Zea mays
  misc_feature: Incyte ID No: 700351235H1
catcgacctagctcgctgcctccagttcctacaccacgagaagggcctgcctcacggcaacctgaagccgactaacatattcctgactggtcctgatctcactccaaagctggtggattacggcctgcacaggttcatgactccaagtggcgccgccgagcagatactgaacctaggagcgctagggtaccgagccccggagctggcgaacgcggggaaggcggcacccacgttcaaggcggacgtgtacgcgttcggggtggtggtcatggagatgctgacgcggag

SEQ ID NO: 6101 - DNA, 289 bp, Zea mays
  misc_feature: Incyte ID No: 700351236H1
  unsure 148, 161, 184: a, t, c, g, or other
ggtcaagcctcctgctgctccccttgttgggtgacagctcttgctacacaggcttgcttatgaagagatgcatagacagttcgcccaacattgggacatacccagacattgggcaagctgctttcggagttgtatatcgaatctttgnatcggttgttctntacttggagctttatgcaagctntgtagagtattcacgctgctaggagacagcatgtcatcagtgtttcccttagcacattttgacatgaatgcacacactctctttgcgatcacaaggccttggcaa

SEQ ID NO: 6102 - DNA, 291 bp, Zea mays
  misc_feature: Incyte ID No: 700351238H1
  unsure 105: a, t, c, g, or other
ggaaggatggcgggaaagttataatcggtgacattatgattgaccactctgggcctatgctggaaactcagctcctgatggacatcggcatgatgaccatgacancaggacgacagcacgacgaaaaagaatggcgtcagtcttcaccaaagcagggttcagcgaatacaagatcctgaaggaatttggacctcgtgttgccttcgaagtctatccgtgagatatatatttacatacatatgtatgcatatgggttgcgggctttggcatgaccatgtcataaataaatga

SEQ ID NO: 6103 - DNA, 289 bp, Zea mays
  misc_feature: Incyte ID No: 700351239H1
  unsure 276: a, t, c, g, or other
cacaaaagttcatcagagtcaagttccagctcatcttcagaatcttcaagcagcgacgatgagggtaggggttcaaggaagtccagatcacagtcgagatcaaagagaacaaggaaggaaaagaagagtcggtcaaggtccaagcacagaggcagtgaaagcgaggaggaaggcctggtacgcctctctaaattcttcgggaagtaaggagtagacgctgttgtacccaagacgccctttcatttgaaacgtagattggtgggtttggatgtatcntcaacacagaata

SEQ ID NO: 6104 - DNA, 290 bp, Zea mays
  misc_feature: Incyte ID No: 700351240H1
  unsure 21, 44-45, 57, 59, 64, 72, 79, 84, 113, 135, 141, 153-154, 172, 181-182,: a, t, c, g, or other
ggaacgcgaagtgtcaacggngctctgccggcgagcagaagtgnnggttgttcattncnaccangtgatttngcctggnagcangagggctcttcggaataagaatggatgtngctctaactctgcttctagacnggtganggttcagcttannagcaggggatcttcatcntcagaatannaacgtgtgttgtngngttgcagtgtctacgcnactagtatttctgntgtnacttatgttctaggtatactgcgcancagagcagagctgangaatatgtactgcttgc

SEQ ID NO: 6105 - DNA, 288 bp, Zea mays
  misc_feature: Incyte ID No: 700351241H1
ggcgactagggtttggctcaccgccctcctgcttggtttcctcgtcgccgcctcccccttcaccagccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactagcaggtgaagaaactgaatactagttggtctgcaaaatgacggtgaa

SEQ ID NO: 6106 - DNA, 288 bp, Zea mays
  misc_feature: Incyte ID No: 700351242H1
gatgaatatgacttcttgaaggatggcaggaaacaggctacaggcaggttggatagagcactggctcgtgtgcgttccatgaatcagtatcctgaagcaagagaccagtaccgcaggctgcaagcctgtgttaacagcctacgagagtcccaggcgatgcaggacaggatgctggctgattcagctggcaccgatgggggtgatttcatgactgaattggaggagctatgccgggatgatggcgatgccccgatgtcgactattcttgacatggagcttactatagat

SEQ ID NO: 6107 - DNA, 285 bp, Zea mays
  misc_feature: Incyte ID No: 700351246H1
  unsure 25: a, t, c, g, or other
ctcttgccttggctattgttccaanagatggggcttccacaaccggtaacactgcatttcaagataaggggtttgatcctacaggatgggaactcgcccttgttaccgcaccgagcaacacgacttcatctgcgtctgtcggtcaattgggtggtggatttgacaagctcattttggacagcctttatgatgacggggcctacaggcagaggcaacagcaacaggtgtatggttcagcagtgcctaatccatcatgtcaaatgatccttcgtgatgtcaaaccaa

SEQ ID NO: 6108 - DNA, 288 bp, Zea mays
  misc_feature: Incyte ID No: 700351247H1
  unsure 253, 277: a, t, c, g, or other
cccaccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggactctccgcggacgcgcgccactgggacgcgggccctcttccccgacgagcggccattcatctnccacgtgtcgcttcttcgcggctncgacggcatgg

SEQ ID NO: 6109 - DNA, 305 bp, Zea mays
  misc_feature: Incyte ID No: 700351249H1
  unsure 43, 181, 270: a, t, c, g, or other
ctttccccgagctctcgaaaccctaggtgcgtgccgaccggcngcggcggcgaggtgatggcgatggacccggacgcggtggcgaaagccttcgtggagcactactaccggacgttcgacaccaaccgcgcggcgctggtggggctgtatcaggagacctccatgctcaccttcgagggcnagaagttccagggcccatccgccattgccggcaagctcggatctcttccttccaggcctgcgagcaccagatcgtcaccgtcgactgcnagccgtcggggccccagggaggaatgctcgtcttc

SEQ ID NO: 6110 - DNA, 303 bp, Zea mays
  misc_feature: Incyte ID No: 700351250H1
  unsure 236, 241-242, 250, 255, 258, 265, 270, 274, 280, 288-289, 300: a, t, c, g, or other
atcactcctagctactcctactctggtcgctgcctattgattgatccatcaatcctgttaattttcagaagagtttcagaagagtcttaatactcctagtcttaatagtcctagctatgcaaatatgcagtgttaatttgcggcagtaccagattaagcttccatccagattggcagcggtcaattcttgtccttggcacactactcgagatgaaataagctttacctaaaaccanaaaannaaagatancaaanaantgggcantagantctnccgaanaaggcagnnggaaaatacangcg

SEQ ID NO: 6111 - DNA, 244 bp, Zea mays
  misc_feature: Incyte ID No: 700351251H1
  unsure 145: a, t, c, g, or other
aaagccaaaggcaagatgttcgggcgcgcgccgaagaagagcgacaacaccaagtactacgagatcctcggggtgcccaagtcggcgttcccaggacgacctcaagaaggcctaccgcaaggcagctatcaagaaccaccccganaagggcggtgaccccgagaattcaaggagctcgcacaagcctatgaggttttgagtgtccagagaaacgtgagatttatgatcatatggtgaagatgcc

SEQ ID NO: 6112 - DNA, 66 bp, Zea mays
  misc_feature: Incyte ID No: 700351253H1
  unsure 3-5, 9, 15, 48, 50: a, t, c, g, or other
tcnnngctnaccgcnttactcacggaccggacgagcactggatgcggnanatgcgacctctgcacc

SEQ ID NO: 6113 - DNA, 298 bp, Zea mays
  misc_feature: Incyte ID No: 700351254H1
gccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcatgacaagttggctgaagtgttcgacatggtctcatt

SEQ ID NO: 6114 - DNA, 297 bp, Zea mays
  misc_feature: Incyte ID No: 700351255H1
  unsure 35, 67, 237: a, t, c, g, or other
caaaccacacaccccacctaccccggccggaccgncaggcagcacagcatggacctcgccctcctancagaaggccctgctgggctgtttcgccgcggctgtggtggccatcgccgtggccaagctgaccggcaagcggtaccgcctcccaccggggcccccgggcgcccccgtggtgggaaactggctgcagtgggcgacgacctgaaaccaccgcaactgatggccatggcgaanggttcggcgacatcttcctgctgcgcatgggcgtgcgcaactggtggtggtgtcgacccc

SEQ ID NO: 6115 - DNA, 297 bp, Zea mays
  misc_feature: Incyte ID No: 700351257H1
actagctaagggcagagccaaatttggggattcttcaactgaagccttgtatagatatagtttgaaagatgatgaacgaacacagagaggaggatgccttgagaggtcaagcagtcaaaaaccagaaggcgatatgggacaagaccatggaaatgagattcttgctgcagaaggcgttttctacttccaacaagttaccccaggaatccatcagaacaaggttttgcaatcatgataagcagatagagcaagcatatgatgatcttttgaattcgacgaaacatactttgagcagca

SEQ ID NO: 6116 - DNA, 279 bp, Zea mays
  misc_feature: Incyte ID No: 700351258H1
  unsure 13, 21, 30, 36-37, 117, 150, 152, 178, 187, 202, 207, 227, 229, 246,: a, t, c, g, or other
tgtcacactactnagccagcncgctctatntctttnntctatccaagccagaaaggtagaaaccccccggaaacaatttccggccatggcgaccgcagcccaccaggttgccgccanttcctctcgtacctttcccctccactcaccacntnggcccttcctccgtctccctcggganagctctgtnctacccgtctccttngggtngctggaaaggtggccaaggntngcctaccgctcggggcngccgcnnggtgccgcgtggcccagntcncaaca

SEQ ID NO: 6117 - DNA, 177 bp, Zea mays
  misc_feature: Incyte ID No: 700351260H1
  unsure 17, 24-26, 34, 49, 71, 86, 96, 98, 101-102, 104, 112, 119, 121, 126, 130,: a, t, c, g, or other
ctgcactcaagcttctnttacctnnnaactcaancttctctcatcctgngcaactagtgatctccttaaancatttcagcttttanctagatatcntnctnntnttgaaggnaagagangntttanggtnatgagcncaaactaagatgcctcctngatttcgtttccacacnacat

SEQ ID NO: 6118 - DNA, 294 bp, Zea mays
  misc_feature: Incyte ID No: 700351261H1
  unsure 48, 164: a, t, c, g, or other
gaattctctaagcacgaatttgaaaacgagaagaatctgctaggaggngctttgggtgccaaagctgcagaagatttgaagctaagaataattgaacataatatcttggttgtgtctaagtactattcgagggttaccataaagaggctgctgatctgctctgnctgagtttgcaggaggcagagaagcatctttcagacatggtgaactcaaaatctctgactgcgaagatcgacaggccgatgggagttgtgagcttccgggtagttcaggactgcaacggcacacttaact

SEQ ID NO: 6119 - DNA, 292 bp, Zea mays
  misc_feature: Incyte ID No: 700351264H1
  unsure 185: a, t, c, g, or other
tgggtctagggtttacactgttgtggttgtggagattgatgatgcagatggtatgagggttgtcgttgggaagcaccggcatgcttgggtggttggaaaagctgatgaggttaaggctgtctcagttattggcaaggtatttgccaagtatttcatgaatgggggtattgaggagggtgaggcangcattgggaaaggcgagttcatgccagttggatcagatggcaatgtcgttctatccttagcttgctgaatgctgatccaggtgattgggtgtatgattgggacttga

SEQ ID NO: 6120 - DNA, 294 bp, Zea mays
  misc_feature: Incyte ID No: 700351265H1
  unsure 2, 74, 225, 248: a, t, c, g, or other
gngccgccgaggggcaaggccgaaccctcctccgttcgccgaggcggagcacgcccttccaggccagcttccancggagcaagagctaagtcgcctcgaattcttcccagctagtagcgtgtgccgtaccccgtcgctcaaccgggatggcgtcgagtggggatccgcccggatctgctgatgagaagaaaactccaatatccgaagggtcttccgacgaacgtnaagggttctccagcaggcttttnaaatccttttgattttggttctatgcaaatttgctcaatgatccat

SEQ ID NO: 6121 - DNA, 294 bp, Zea mays
  misc_feature: Incyte ID No: 700351266H1
  unsure 36, 121: a, t, c, g, or other
gggatagaagcttggagcctcgtgtctccgattttngcctcgcgaggctgcttgtagacagtgctgcccacgttaccaccgtcgtcgcgggcacctttggatacctagcaccagagtactngcaaaacgggcatgctactgagaaatcagacgtgtatagctttggagtgcttatgctggagctagtgaccggaaagaggccgaccgattcttgcttcatcaagaagggactgaacatgttggctggctgaacaccctaactggggagcaccggctggaggatatcatcgatga

SEQ ID NO: 6122 - DNA, 290 bp, Zea mays
  misc_feature: Incyte ID No: 700351267H1
  unsure 68, 254: a, t, c, g, or other
cagaatcgccaaggacagcagcctcctggaattctcaagaaacctactgagggtgattcaaactcatncaaaacaagtgaaccttgtcgaacctcttcttgaaaagaggaggtaactctaaaaacgtagccgataaaacgcatggaatcaagccggaagagcctatggtttttgctattataacaagaggtaaatatagatgaactcgttgtaattccaacaggagcttttggtgtcatggacttagtcatgantctctctccccctctcattctcccctcttggttatg

SEQ ID NO: 6123 - DNA, 294 bp, Zea mays
  misc_feature: Incyte ID No: 700351268H1
  unsure 78, 231, 286: a, t, c, g, or other
gggcttggtccccaggtggaaggatctgttctgcaaaggggacagcaaggtacctttaggctaaaggactcggcgtcnagtattctagttgaagatctaaagagaaagccaccttgctgccactatgcctaacttttctggcaactggaagatcatccgatcggaaaactttgaagaaatgctaaaagctctgggggtgaacatgatgatgaggaagattgctgtggctgnagctccaagccagcagtggagatcaaacaggagaatgatgacactttctacatcnaaacctcc

SEQ ID NO: 6124 - DNA, 289 bp, Zea mays
  misc_feature: Incyte ID No: 700351269H1
  unsure 270: a, t, c, g, or other
atcggcacgggcggtaggataaagtagcatagcataccacaaaaggtgctgcttgacagatggcaagcttcccacacctcacgcagatggagcatggcctagccagtggtgcctcccatggcacgccgagcttcttcttctgccatggcacagccacggcggattcagcctcgctggagacctcgtctggtgttctcgacacctccccacgaggcattcttctgacgacaacaaggcctgcaggaagcacaaggaagatagtggtgccgncttcagtctgctcgtccaa

SEQ ID NO: 6125 - DNA, 289 bp, Zea mays
  misc_feature: Incyte ID No: 700351271H1
  unsure 51, 89, 278: a, t, c, g, or other
gcaaaacactgaaaaagaaaaggccatcgaaaacgccgccgccgcctctgnatgctttccgccgtgcgatgtggtgcccttcgccggtngcgcccgccgccgcacctcctcccacgcatcctttcctcctcctttggtacatctcccgcgcgaccaccaggtgggggcgtgctggagctcccggagtggagaagtactggcgcgacgtacgagcgggtggcgtgcgcgtattccccgtcggcgagagcggtctgcacggcggggcctgcgccgattantggtcgtcgca

SEQ ID NO: 6126 - DNA, 291 bp, Zea mays
  misc_feature: Incyte ID No: 700351273H1
  unsure 2, 9, 17, 25, 30, 33, 35, 43, 81, 120, 124, 126, 130, 150, 173, 191,: a, t, c, g, or other
cnagaatgnagggcatnatactatnatccnggntngtgccgantatgggagtggtagctctcgggattgtgctgcaaaggncccaatgcttcagggagtgaaggctgtgatagcaaagantttnanaggnttcacgcagcaatcttgttnggcatgggaagcatccctctacnctcaaagcaggggatgangnnganacctggggcctaaccggacnatgantngctanacaggtcccnctncccaancatgtgggtgcagatttangcttggcnaagatgttnccgtgac

SEQ ID NO: 6127 - DNA, 281 bp, Zea mays
  misc_feature: Incyte ID No: 700351274H1
catataagctgcagaggacaggatgcttctggcgaggaagtgatcaagccttatactccaactactctggactctgatgttggatcttttgagcttgttataaagatgtatccccaaggaagaatgtctcatcattccgtgagatgaaagttggtgattatatgtctgtgaagggacctaagggccgtttcaagtacctacctggacaatgagagcatttggatggtagctggaggatcaggcattactccatgttccaatcacaagggcattcttgagaa

SEQ ID NO: 6128 - DNA, 288 bp, Zea mays
  misc_feature: Incyte ID No: 700351279H1
gcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagag

SEQ ID NO: 6129 - DNA, 290 bp, Zea mays
  misc_feature: Incyte ID No: 700351280H1
  unsure 74, 77: a, t, c, g, or other
catttctgcatccccctcccgccgcgccgcctcaccgccgccggagaagatgggtcgcgtgatccgcgcgcagntanagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcatttccgccacccattcaggtacaagcaccagaaggagctctttgtcgcagccgaggg

SEQ ID NO: 6130 - DNA, 289 bp, Zea mays
  misc_feature: Incyte ID No: 700351281H1
agcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcaga

SEQ ID NO: 6131 - DNA, 287 bp, Zea mays
  misc_feature: Incyte ID No: 700351284H1
  unsure 9, 19, 21, 23, 25, 65, 69, 72, 106, 121-122, 125, 127-128, 150, 152-153,: a, t, c, g, or other
aaagcgcanaacgccggcnancnancgggacgttcgaggatcgcaatgtgagcacgagcaggganacanaanatgcttcatcctaagctggtcggtgtctcggcanacgtctcggagtatnngtntnngataatcgcccacagttgtttncnnacttnccnngcgcggtgacaatttacnanacagttnaatcagttgaacaaggacatcagcntgagcntgataagggcnancangncccagttccacgangtacaagntatcgaagggcaagtgnccgctgnaac

SEQ ID NO: 6132 - DNA, 239 bp, Zea mays
  misc_feature: Incyte ID No: 700351286H1
  unsure 31, 192, 206, 237: a, t, c, g, or other
actgcttgtgatgccatctactgcgacgaanacgactgctacgacctcctaggggttaagcaggacgcgaacgcgtcagacatcaagaaagcgtactacaagctctctctcaaacaccacccggacaagaatcccgatccggagttcgcggaagctcttcgtcaagatcgcaatgcttacgagattctgaangatgaatccactanggcgcatatgacttgccattgaacatccggngg

SEQ ID NO: 6133 - DNA, 284 bp, Zea mays
  misc_feature: Incyte ID No: 700351289H1
  unsure 46, 157, 184, 228, 254, 261: a, t, c, g, or other
ggaatttgaagagagatatgatcaaatctttaatgtgaacaataanttgattccaaagagttatctgttggtagagctgccttatcaagtcttctgggtggtgttggctacttctatgggcagtccaaaattgcactcccgaaaggttttacaccanaaaaatggggataagtacatttcatantgggcctgctgcattaaaatacagctgtccccagccgctccttncttcccaaggggatttctgtgggatnagggctnccatcagtaagtcatttggcgtg

SEQ ID NO: 6134 - DNA, 279 bp, Zea mays
  misc_feature: Incyte ID No: 700351292H1
gggtcgatcactgttttgtcttggactcctccttcggtatggttatcaattgatgctaacatctgaaaatcagcttgattttcccaagatcatcaacttgctccagagaaaatatcttctcaaggatgatttcagcttgaaggttcgagctttgcagactttgggatacatacttattgcgaagcctgaatttatgctacaaaaggatatgttgaatctcatagagacagcatctcttctgaggttgattatagattcaagattcaaggacttcaaaac

SEQ ID NO: 6135 - DNA, 269 bp, Zea mays
  misc_feature: Incyte ID No: 700351293H1
  unsure 6, 52: a, t, c, g, or other
ctcgtnggccacccgtcttgttgaggcccctaagaccgacctggacttctgnaaagttcttttcccggttgctgtggcgcatacaattggccatgttgctgctacagtgagcatgtctaaggtggcagtgtcattcacacacataattaaaagcgcagaacctgcattcagtgttttggtgtcaaggttcttcctggggagacgtttccaattccagtatatctttctcttcttccaatcattggtggttgtgctctagctgctgtcaa

SEQ ID NO: 6136 - DNA, 277 bp, Zea mays
  misc_feature: Incyte ID No: 700351294H1
tcatcagataatattgattttgaagttctccgtggactgacaaattcattacttgctgctaagaagccagatgaggcagttgatataattctgttatgccgtcgaaagttgaatgaaaagagtcaaacaggactagcagatttggaggctacaaatgacaatggtcgccaaaagcctcaagatattgacccgatcccaagttgacctgctttagggaaggctattccgattggggtcatatcagtgatgcatttcgtctacgataagctaataactg

SEQ ID NO: 6137 - DNA, 281 bp, Zea mays
  misc_feature: Incyte ID No: 700351296H1
ccgtgcagtggcgttattgactctaccggttcttgctagctacccattctttccttcgttgtccgggttcgggctcatggtggtagtaaattgtgcatcttttctgaagaatacattctcggtaactaccattaccgtgttcaacattttgatgaatgaagctgtgactcaggatgtaagagccgcagccaatgggatagctgtaacactaatgtccatctctaaagcggttgctccagctgttgcaggaatcatattttcgtgggcccagaggcgtcaaa

SEQ ID NO: 6138 - DNA, 297 bp, Zea mays
  misc_feature: Incyte ID No: 700351301H1
  unsure 3, 7, 29-30, 82, 93, 188, 216, 238, 250-251, 258, 264, 280, 288-289: a, t, c, g, or other
gcncgtngcgccgacaggatgggcaagtnncgtggacttcgtactgctaggaagctccgtagtgcaccgacgagaccagaantggcatgatanacagtataagaaagctcatttgggcacagccctaaaggccaacccttttggaggtgcttctcatgcaaaggaatcgtgctggaaaaagtaggagntgaagccaaacagccaaattctgccatnaggaagtgtgtaagggtccacngatcacgaaggnnggaaatngaaccnttgtacccatgacggntgcttgannttatgaga

SEQ ID NO: 6139 - DNA, 300 bp, Zea mays
  misc_feature: Incyte ID No: 700351303H1
  unsure 31, 91, 122, 135, 146, 153, 158, 171, 219, 227, 236-237, 278: a, t, c, g, or other
gccgcaggagcatctgcatctctcgcccacntccgctccgcctactgctgctggtggtagggaggcggagaaggaggcccttgcgcccgcncgctcggccggatcagagccgtagcaaccancacccatggcggnagttcacgaanctttggncagcngtaagaggaaganaggttttggtggactacttggtgaagttccgatggatcctcgtgatantcgtggtncttccattnnaactctgatctacttcaacatcttcctgggcgaatgtggtncgccatgaagtcggagaagaaa

SEQ ID NO: 6140 - DNA, 298 bp, Zea mays
  misc_feature: Incyte ID No: 700351304H1
  unsure 258: a, t, c, g, or other
gtctttccccttcccagccgccctcttccccccctctcccggtcgcctctaacgtcgctggtgactcacgaagacctccatcgacggcggtgaaactggggccgacttctggagggtttgacttgttggatacagcgccggctcttccaatcgccgggtgctctctgccactctgtcttgcggagcccccaccgcggaaaccggttggtgcgcgtggccatggcggtggcgaaggtcaaatcggtcgccctctccgtnagtcacaagtgccggaacatcttggccgccggttgggaag

SEQ ID NO: 6141 - DNA, 303 bp, Zea mays
  misc_feature: Incyte ID No: 700351307H1
  unsure 30-32, 37-38, 41, 45, 47-48, 54-55, 61, 63, 66, 69, 82, 111, 115-116, 134,: a, t, c, g, or other
ggccctaccgctgtcaccggaagtgtctcnnncctcnnggntggncnncatggnntccatncnccntgnatctggtgacacnaccaatggatgcatgtcaactggaccacnctanntctcctgcgagcaaggancatggggcnccagaagatgaganccgccatgctanttgatcttggaaacgtgacagctggagcagntggtgttgctantntcaatgtcaccgacagccagatcnngctgtttgggccaaactcaatncattggccagagctgttgttgttcacgctgatcctgatgatc

SEQ ID NO: 6142 - DNA, 299 bp, Zea mays
  misc_feature: Incyte ID No: 700351308H1
  unsure 33, 42-44, 46, 71, 88-89, 95-96, 101-102, 117-118, 123, 132, 144, 153, 174,: a, t, c, g, or other
ttccgccgtctcgcctcctcacgccattaaacnccactcgcnnncncggcggctggcggcgagccctcacncatccgagcaagccgannaggaanngagcnngcgaaagtatcaggnngaggnatgggtacnctggggcgcgcnatcttcacngtgggcaagtggatccggggnacggggnaggccatggaccgcatcggatccaccatccagggcggnctccgcgtcgatgaacaggtttcaaggcatcgtacaatcatgaatatttttganaaagagccaaggatccatagagangt

SEQ ID NO: 6143 - DNA, 296 bp, Zea mays
  misc_feature: Incyte ID No: 700351310H1
tctgcttccattctgttcaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttcttt

SEQ ID NO: 6144 - DNA, 297 bp, Zea mays
  misc_feature: Incyte ID No: 700351311H1
  unsure 154, 190: a, t, c, g, or other
gagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcngtgagccccccaaaccagcagtggcaccagctgcangtgctccacctgttgagaaaccatctgctgcaaagactgatgcggccaagcaggttgctgctggggttaccagccaaaccaataactaccacagggctgatggtcag

SEQ ID NO: 6145 - DNA, 297 bp, Zea mays
  misc_feature: Incyte ID No: 700351312H1
gcaaatactttgttcagcttctcatttgtgccttccataatgtaccgtatccagtgtctgcttctttctgcaaagttgaaaatccagttgggcccaagaatgcaacagttcaacataacagctatgaagattctggaagcacttacaacaaaggaatgccaggagaaattttcaatggaatcattagaaacacttggagattctttcattaagtatgttacaggccaaaatctttttaacaaatacaaacatcgagaggacatgctaacctctatgagagaagaaaaggtctccaac

SEQ ID NO: 6146 - DNA, 296 bp, Zea mays
  misc_feature: Incyte ID No: 700351314H1
  unsure 160: a, t, c, g, or other
cttgaagaacatgttccccagtgagaaagagatagttgttaaaagtcaaatccttgctggtggccgagggctgggaactttcaaaagtgggctgcaaggaggtgtccatattgttaaggctgaggaagctgaaagcattgcacgtaaaatgttaggccanattctggtaacgaaacaaactggtccggagggaaagattgtgagcaaggtctacttgtgtgagaaactgtctctcactaatgagatgtattttgccatcacccttgataggaaaactgctggtccgctcattattg

SEQ ID NO: 6147 - DNA, 296 bp, Zea mays
  misc_feature: Incyte ID No: 700351315H1
  unsure 180: a, t, c, g, or other
gttccagctagctaggagagagctttatttaggcggcggcaacaagatgaacaggaagccaggagactgggactgcagggcgtgccagcacctcaacttcagccgtcgggacgcatgccagcgctgcagtgaaccacgtggagttggtgatccgtagcggcggtggtggcgacttgggtnggcgtggtggttcctccttcggcggtggctttggtgctggctctgatgtccgccctggtgactggtactgctcctgcggcgcacacaacttcgccagccgctccaactgcttcagg

SEQ ID NO: 6148 - DNA, 295 bp, Zea mays
  misc_feature: Incyte ID No: 700351316H1
  unsure 107: a, t, c, g, or other
tcagcttggagtcaggattaaggctggcctgttctacagatttattggcttccgtgaacaggatgtaagcaacttgaccaacttcatacaaaagaatatgggtgtcncaccagatgaaaaacagctttctgttagtggccagaattggggagggattgatatagatggaaacatgctaacctttatggttggttcaaagcaagcatttgaggtgtccctaccagatgttgcacaaacccagatgcaaggaaaaacagatgttctcttagagcttcatgttgatgatactactgga

SEQ ID NO: 6149 - DNA, 293 bp, Zea mays
  misc_feature: Incyte ID No: 700351319H1
  unsure 33, 86, 127, 129-130, 246: a, t, c, g, or other
caaccacctaatgaaggtgcacggaattcgcanggtttctgttctttacctgatcagattgccgctggacgtcctaatttctggcncactgtaaacgctcattaccaagaccagcaaggcaatcaantnngttccctggttcatggtccatgatgccttcaagtactggctttgggatgaacagacagagctatccaatgatccaggaagtcggtgggatgtctcagagttgtacaaacaccaagnttgggaatggagtttatgctgcactacctggccgaggcattgatcga

SEQ ID NO: 6150 - DNA, 295 bp, Zea mays
  misc_feature: Incyte ID No: 700351320H1
  unsure 21, 56, 62, 120, 127, 176, 201, 203, 235, 238: a, t, c, g, or other
gagccttcaagatgccttgcnaaaggactcgactgcacggcaagtaggtgtgacancgacanggaacaaccccaatccttttcaaggacttgctaggctaaaggggacagtaaggcacancgtatgntccgcgtggcctctttgggtagatggagttcatctccgacatgtctcgntcactgaaacagcgatgatctcgcngnttgatcagcgtaggaaaagggttgcaacttgnaanggctatatttgttctcgagtcacaagacacgacctgtcctccttccagttgggaggg

SEQ ID NO: 6151 - DNA, 291 bp, Zea mays
  misc_feature: Incyte ID No: 700351321H1
  unsure 57, 175: a, t, c, g, or other
gcacaacatgacgcgcatccaccgcctccgccccctcttcctcttcgttctcttggngtcgctgcaatgcggtgcggcgacggcggcggctggatacggaggtggcgccgaggggttctgctcggcggaggtccagcaagtgctccggggatcagccgctctactggaaggtcanccatcccaacctcgcgcccgcgcacctccaagatttacctggcttcacacgtatgttttcaaaagggatcatgctttaataacaccagagagtcatgtattcagtcctttgcctga

SEQ ID NO: 6152 - DNA, 294 bp, Zea mays
  misc_feature: Incyte ID No: 700351322H1
gttgaaggcacctagcagccgccactcgccgaactgaggaacacgccgggcgacgggatacagcagcagcgcgcccctctctatcctcgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttga

SEQ ID NO: 6153 - DNA, 295 bp, Zea mays
  misc_feature: Incyte ID No: 700351323H1
  unsure 53, 61, 233: a, t, c, g, or other
cctgagttcaccacctctgacactgtctccgagctcactatcaaaccatcctncaaaaganaccgttgagatccctgtacaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggnagcttcaaggcaggcgagcctggcaaacttgtgctaatgtgaacaaccctgcatccaagaag

SEQ ID NO: 6154 - DNA, 281 bp, Zea mays
  misc_feature: Incyte ID No: 700351324H1
agtaccatccggctcccaggggcaaactgcaaagccaaggccattccccgtgcctgatgggataccgaaaacacaggaagagctcaccgaagaagaggaagcgttgatgccagagtctccatacacaaggttgctgagaaggatgggtagataccctgaatggtacaccccacgccctgatcatgagactgactgaatcaagtcatctaccatccaggtgtcccttttggaagttttgcagcatgataatctgaagctgaagctcgttttatggtatgtgg

SEQ ID NO: 6155 - DNA, 292 bp, Zea mays
  misc_feature: Incyte ID No: 700351326H1
aagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatggatcaaagg

SEQ ID NO: 6156 - DNA, 291 bp, Zea mays
  misc_feature: Incyte ID No: 700351327H1
  unsure 182: a, t, c, g, or other
gttaatgagggtttcactggggatacacaaggaagacatcgagtctgccatcaggacgtaccatctgatgtcccagcgctggtttactcatgcttcaccgacgcttttcaatgctggcacgccgaggccccaattaagcagctgttttcttatatgcatgaaagatgacagcattgagggancctatgaaaccctgaaagagtgtgctgtaataagcaaatctgctggaggaattggtgtctcagttcataatatccgtgctactgggagttatattcgaggaacaaatgg

SEQ ID NO: 6157 - DNA, 291 bp, Zea mays
  misc_feature: Incyte ID No: 700351329H1
cgcacaccagcacctgccctcctcgccgtcgccgcctccctccgcgcgaccgatctaccctccgccgccaccatgttcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaa

SEQ ID NO: 6158 - DNA, 293 bp, Zea mays
  misc_feature: Incyte ID No: 700351331H1
  unsure 136, 138-140, 142-143, 145, 243: a, t, c, g, or other
aacctctcaaaccctagccgcctcctgcaagtttcagagctcaggaatctgcgccatggcgagtgagacggagaccttcgcatttcaggctgagatcaaccagctgctctcactcatcatcaacaccttctactcnannnannanacgcttcctccgcgagcttatctccaactcttccgatgcgctggacaagatcaggttcgagagtctcactgacaagagcaagctcgatgcgcagctgnagcttttcatccaccttgtcccagacaaggccacgaacacgctctccatc

SEQ ID NO: 6159 - DNA, 294 bp, Zea mays
  misc_feature: Incyte ID No: 700351333H1
  unsure 16, 23, 86, 161, 164: a, t, c, g, or other
cgctcgctagctaggntttccancaataggcggcgcccaccacctcccgccgcggccccggcggcgcgcgcaacatggacgacganaacctaaccttcgagacctccccgggggtcgaggtcgtcagcagcttcgaccagatgggcatcaaggacgacatnctncgcggcatctacggctacggtttcgagaagccctccgccatccagcagcgcgccgtgctccccatcatcaacggccgcgacgtcatcgcgcaggcccagtccggtaccggcaagacgtccatgatctccc

SEQ ID NO: 6160 - DNA, 290 bp, Zea mays
  misc_feature: Incyte ID No: 700351334H1
  unsure 60: a, t, c, g, or other
gaaaggaaaggacaaaggagcggcggcgaggtctatggcgtcgacggcggggtacctggngcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaattccagcaccccgatccctacattgttccatg

SEQ ID NO: 6161 - DNA, 284 bp, Zea mays
  misc_feature: Incyte ID No: 700351336H1
cacattgtgggatcctgataataatgcgcttgttggtgtcattgcagaaacactatcgccagtgacaaatctttctttcgttgggacatcagtgtttttgatgtctctatgtcagagttcaagaccacagattgctctatggaatgtttcaaatctttccatgcagtggtcttacagcatttatgcagaagctgcatgctgttcgccagatgggagtgaattgcagttcttgctcttcttagttgtccgatggagaagcatcaacacaacaagatggagtaatt

SEQ ID NO: 6162 - DNA, 287 bp, Zea mays
  misc_feature: Incyte ID No: 700351337H1
  unsure 137-153: a, t, c, g, or other
ggcaaacaagcttgctactgtgatttctcgtccgagcagcggcggaggagagagagagagcatggccgaccacaaggaggagcctgtgccggagtctgtgatggacaagatcaccgagaagttccacggcggggacnnnnnnnnnnnnnnnnntgactcggacgacgagaagaaggggtcctcgttggcgtcggcggcggaagccatgaaggccaagatctaccgccttttcggccgggagaggcccgtccactccgtcctcggcggcggcaagcctgccgatctta

SEQ ID NO: 6163 - DNA, 196 bp, Zea mays
  misc_feature: Incyte ID No: 700351338H1
gcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaag

SEQ ID NO: 6164 - DNA, 290 bp, Zea mays
  misc_feature: Incyte ID No: 700351339H1
  unsure 45, 284: a, t, c, g, or other
ctatgctctcctctccctgctcgcagtcagagcacagggactgcntccggagaccggagcaggccgcaagcgtccaggtttcgagacgccagcacgctctcgcagtacagcagcattatcagggagcgtgccgtgggagtgggaggttgcctcaggtgacggagagtcgccggcggcgaccattcggtgtctgagatgaaggagagaggcggctctagggcggcagtggacgagcgctacgcgcagtggaagtcgtcatccccgttctctacgactggtttgcnaaccac

SEQ ID NO: 6165 - DNA, 285 bp, Zea mays
  misc_feature: Incyte ID No: 700351341H1
agcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccg

SEQ ID NO: 6166 - DNA, 286 bp, Zea mays
  misc_feature: Incyte ID No: 700351342H1
  unsure 24, 38-39, 43, 45, 50, 91, 94, 115, 128, 130, 154, 156, 181, 238, 250, 253,: a, t, c, g, or other
ccgcgccacctacctcggcgtcangagcaggccgcagnngganangaggntcggtgacaggtacctggccggcgacaacgaggacctgccngantccgtcgactggcgggccaanggcgccgtcgcgnangtcaaggaccagggcagctgcggnanttgctgggctttctcaacaatagcngctgtggaaggcatcaaccagattgttactggcgacatgatctccttgtctgagcangagcttgttgantgnganacttcatacaaccangggtgcaatggaggt

SEQ ID NO: 6167 - DNA, 283 bp, Zea mays
  misc_feature: Incyte ID No: 700351343H1
ctttgaaattgaataaagaaagctgtttgtagttttaaaatgcctaattgataccaataagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgcttgtatc

SEQ ID NO: 6168 - DNA, 289 bp, Zea mays
  misc_feature: Incyte ID No: 700351344H1
  unsure 20, 23, 25, 30, 34, 38, 40, 58, 61, 68, 71, 73, 75, 78, 142, 150, 153, 157,: a, t, c, g, or other
ctctcagcggcgacgcctcnggngntcctncccngcancntctccggactcccacgcngtngggacancantncnggnaagagcccgatctcagagcccgcgagcaatccttgatatacctgatggctatgattgatgagcntctgtacncanttgntgtactgattgatgagctnangaatnaggacatncagttgcntctaaactccattanaagactttcgncaattgcacgggctcttgagagangaaagaaancaggaagganctnattccctttcttagtgaa

SEQ ID NO: 6169 - DNA, 279 bp, Zea mays
  misc_feature: Incyte ID No: 700351345H1
  unsure 106, 110, 139, 209: a, t, c, g, or other
actcctaccccacacagaagcggcggcggcggagcaaacgcaggcgaaggcgagggtgtgagggaaggagcaccagccatggtgcacgtcaacttctaccgcaacntatnctaagacgttcaagaaaccaaggcgtccntatgagaaggagcgtcttgatgctgaactgaagctggtcggtgagtatgggctgaggtgcaagcgtgaantttggaggtccatatgcactgagccaggatccgtaatgctgaaagcattgtcaccttgacgagaagaacc

SEQ ID NO: 6170 - DNA, 287 bp, Zea mays
  misc_feature: Incyte ID No: 700351346H1
  unsure 165, 167-168: a, t, c, g, or other
gtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggttttccacccgaacatcnannggcaacggcagcatttgccttgacattcttaaggaacagtggagccctgctttaactatctcaaaggttctcctgtcaatctgctcactgctcagggacccaaaccctgatgatcctct

SEQ ID NO: 6171 - DNA, 288 bp, Zea mays
  misc_feature: Incyte ID No: 700351348H1
  unsure 77, 219, 233, 260, 285: a, t, c, g, or other
acacttggaactgcatgcacccaaggcaaaacgtcggtcatatatcccaacgaaaaatggaacagccatgatgcttnccgctccatattcattacgaagatgtactacgtcaggatctgttgctcaaacagaatcatgccaatatcatgcaagttccagggttgtttgaggtcaaattagcaccaaaagccggctctgatctcaagatcccaattgggnaaatggccatggangttttgagtggtcagagattcaaagangcaaaaattgacccttcggcaaagnaag

SEQ ID NO: 6172 - DNA, 231 bp, Zea mays
  misc_feature: Incyte ID No: 700351349H1
  unsure 2, 53, 81, 100, 164, 189, 197, 229: a, t, c, g, or other
anatccgcaacgagaacggcctcacctccgccgaccccgacgcgccgctggangccggccagaagctcgccatcccgctgncatgcgtctgcttcaactncgtccgacaacaacctccccgcggtgtacctctcctacgtcgtgcaggtcggggacaccgtgcncgccatcgctgcaagttacgagacnaccgtcanggatgtcatgaatgtcaatgcatggggagtcnct

SEQ ID NO: 6173 - DNA, 294 bp, Zea mays
  misc_feature: Incyte ID No: 700351351H1
  unsure 10, 45, 54, 56, 91, 214, 240, 249, 252, 261, 267, 281, 283, 286, 289-290: a, t, c, g, or other
actgattggncgtgtcagagccatctctgccacaaacttgtatcntcgtgtatncntggttatgtcaattctgatgatataaaggagactngctacacttacattatgccaaagaacatattgaagaaattcatatgccatagcagatctgcggacacaaattgctggatttttgtatgggctgagtccacaggacatcctcaagtcaaagagntaggtgtatagccatccctccacggntgggacccnccngtggtgacncttccngcaacttccctgancnganccnnaagg

SEQ ID NO: 6174 - DNA, 293 bp, Zea mays
  misc_feature: Incyte ID No: 700351352H1
  unsure 143, 182, 202, 256, 266, 281, 292: a, t, c, g, or other
aagaaatattgttcagaaaggggatacggtggtcgatgccacatgcggccatgcgggaatgacaatgacacgctcgctctgcttaagatggtggctgacaaaacaggccgtggatgtgtttatgggatggacattcaagaatnctgcgatagagatacttcctcttttctgaaaatggccgncgatgatgaacatcatgtgngggtttgaactatgaagctttacctaatttcccctgaaggatgaattaaaaggngacactatgnatctgatttgacatnaatatttacanc

SEQ ID NO: 6175 - DNA, 121 bp, Zea mays
  misc_feature: Incyte ID No: 700351353H1
aattcgtagcaggaaagtgtgaccagacatattggatttatgtttcagtgcatgtacataaatccaattcgtagcaggaaagtgtgaccagacatatttgatcctggtgcttcattgttga

SEQ ID NO: 6176 - DNA, 286 bp, Zea mays
  misc_feature: Incyte ID No: 700351354H1
  unsure 9, 40, 84, 124, 139, 141-142, 144, 155, 158, 160, 171, 175, 179-180, 191,: a, t, c, g, or other
ctcgtgaanatcctccgcagcttgatgagcatttctcganaccaatgaaagagtttgtctcactatgtttaaagaagaatccancagagaggcctagtgccaaggagcttcttaagcatcgttncaggaaatgcccgananncnccagggctttngcngngaataagagancggncatnntttgcagcaanaagctggtgcaanacnngtggncagcacggatggggaggcggntttggtagggcgctatcnaggtcatggganaaaggaanngcccnnnngggng

SEQ ID NO: 6177 - DNA, 293 bp, Zea mays
  misc_feature: Incyte ID No: 700351355H1
tcgtgggtttcagtacgcccagcgaaatgcaggacatcgggaggacatgccgttgtgtgcgctgctgttagcttcagaccatgcattgacattcacaagggaaaagttaaacagattgttggctctactcttcgggatttagcaaatgatagcatggaacttgtgacaaactttgaatcagacaaatctcctgcagaatttgctaaattttataaagcagatgaacttctaggaggacatgttataatgctggcgcaaatccttcaagccaggctgctgcactggaggcacta

SEQ ID NO: 6178 - DNA, 288 bp, Zea mays
  misc_feature: Incyte ID No: 700351357H1
  unsure 6, 217, 237, 242, 246, 250, 253-254, 264, 268-269, 272, 276, 278, 281,: a, t, c, g, or other
cgcganccccggccgtccggttcccatctgcacgccgcgccgccgagatccaaggccattttggaggacccagcgaactttgacaccctggctatggtgtttaacaggtcgagcagatttggaaggctgcagggagtgaagtgtgcgattgcagggaggaacctttacatgaggttcagctgcagcacaggggatgccatggggatgaacatggtcnccaaaggtgtacaaaagtgntgaanaccnccanggnnaacctccccnaatnnggntttnancanaanntng

SEQ ID NO: 6179 - DNA, 292 bp, Zea mays
  misc_feature: Incyte ID No: 700351358H1
  unsure 36, 41, 62, 64, 77-78, 134, 138, 143, 150, 188, 204, 216, 225, 229, 233,: a, t, c, g, or other
ctcctccattgcgccgccgccactctcctttcggangaggnggaccaggtaagcagcagcangnaccctagcaccgnngcatccgcagccatgggtatcgacctcgttgccggtgggaggaacaagaagaccangcgnacagngccgaantccgacgatgtttatctcaagctcttgtcaaagtctancgtttttggtcaggangaccaagagcancttcaaggngtcntctnagaggctcttcatgagcaaaancaattggncaaaaatttccatgngccgnttgtaaatt

SEQ ID NO: 6180 - DNA, 291 bp, Zea mays
  misc_feature: Incyte ID No: 700351359H1
  unsure 179, 186, 188, 193, 196-198, 208, 210, 225, 228, 235, 238, 245, 258, 260,: a, t, c, g, or other
gacggcaagacggccactcccatccaacactgttccagacttccagtccagcgcccggctaatagccaagcagagcttctccctagcctttgcttgctcttccacagcgcaaagctccgagatgatgatcaggcgcggcagcagcaagatctcctcacccctcgccctcctctgcctcntcctctnanactanctnnnccaagtcatngnctgtcctcctcaaantgnggggagntgntcgctcntgcatggggcggncntnnnntnnnnnngngcggggnncnagngggg

SEQ ID NO: 6181 - DNA, 294 bp, Zea mays
  misc_feature: Incyte ID No: 700351360H1
  unsure 183: a, t, c, g, or other
atggaaaccaagcttcttcggcgtttaggaactgcatgtgcctcagatgctttacccagcagctgatcaatgcgtatactgttttgttccgagctggagcagtgcattctgtttcccccgctattgaagccactcctgttgattcaactgaaagctccttcgatacatatcgttcgccgccangacctctgccctatgatgatccacgattttcccctcctgctcgtgactggttaaggagtgagaacccaagccattccccagaggatcggaaccattagagcaattgaggtg

SEQ ID NO: 6182 - DNA, 296 bp, Zea mays
  misc_feature: Incyte ID No: 700351361H1
  unsure 262: a, t, c, g, or other
agagatctttccttggaaagtttatcggaagaaaaacctgaagttaataaggcccacaccgatggtggtacagctgtaatacacaatcaaaatcggagcactacagctgctattgctgcgctaccaaagtatttgcatcgccatgctgccactgaagccaataatgctggtgatatttcatctgttcaggagctggatggtgaaggtgttaaagctagcacggatgttgatacaactggaacagatgtccagcacgggagcntgaagctactaaggccaacgctgctggtgatgcc

SEQ ID NO: 6183 - DNA, 297 bp, Zea mays
  misc_feature: Incyte ID No: 700351363H1
  unsure 4-5, 18, 21, 23, 76, 81, 91, 137-138, 143, 165, 167, 170-171, 173, 211,: a, t, c, g, or other
gggnnttctcgacctgtntgngnaggtcttcttaatataatgcctggggctgtcttacccccgcaagttgattttntaaanagaattaacncggtagcaatgcattcaccattttatgctggggaaacataatatanncatanaatgtatggatcttccattgtnanaanncnacacaatatttttccaagatttctgtcaccagcttatnattgantntnagggtgaataagaggntttgtcagccannattcnagcnaatcngtctnnganatggancgaaacgggngggtgtna

SEQ ID NO: 6184 - DNA, 72 bp, Zea mays
  misc_feature: Incyte ID No: 700351365H1
  unsure 2, 10, 24, 54-55, 57, 66, 69: a, t, c, g, or other
anatgatcanagtgagtcccctcntcctcgcccgcacgctccgtgttcattgcnncnctcactcangcntct

SEQ ID NO: 6185 - DNA, 129 bp, Zea mays
  misc_feature: Incyte ID No: 700351367H1
  unsure 124: a, t, c, g, or other
tgttgttaggaagagaatcaagctcagtgctgagaaggctatcttcatatttgtgaaaaacacccttccaccaacagctgctcttcatgtcttcaatctatgaagagaacaaggacgaggatgntttct

SEQ ID NO: 6186 - DNA, 291 bp, Zea mays
  misc_feature: Incyte ID No: 700351368H1
  unsure 264, 286: a, t, c, g, or other
agcttatatatgctagagagggtgcaaaggatatgatggataggtcatgttctgatttaccgtggcatgttagccttgaggttgatgggaaaaacattgaaattccggaggatgcagaaggtgtgattgtaatgaatatccctagctacatgggtggtgtggatctgtggcaaaacgacaatgaccataatgatgatttcagattgcaatccattccatgaccaaatacttgaggtggttgtatatccgggacatggcatctangcaaactgcagtcggactttcnaaggc

SEQ ID NO: 6187 - DNA, 287 bp, Zea mays
  misc_feature: Incyte ID No: 700351369H1
  unsure 112, 170, 186, 191, 193, 214, 222, 230, 240, 243, 249, 261, 263, 267: a, t, c, g, or other
caagcctcagatctcagtcacctgcgccgccgctttcgttcgtgtggaggggagaagagaggaaatggcggcgaccgagggcgtgctcctggggatgggcaaccccctcctncgacatctccgccgtcgtcgatgacgccttcctgacaaagtatgacatcaagctgaanatggtattcccgcgangagananattaactatgtaaaacgattngtaagcangatcaatnttgaatattnggnggaagnaccacccagaantntatnagggttgcccatgaattttc

SEQ ID NO: 6188 - DNA, 287 bp, Zea mays
  misc_feature: Incyte ID No: 700351370H1
  unsure 143, 151, 159, 161, 167, 169, 197, 199, 202: a, t, c, g, or other
tgaaaaggaagtggaagccgtctccccaaaaggaagaacaagatcgaagccttctcaggtgaaatgccaccgtgatgaggtcttgcagatcacagggaacagaataagcttggcaaaacaggttgatgtcagcattatggttngcccaagncttggggngnaacccnancttgtttcccaaagggcattttgttgananagnaagccaaaaaggctgcttcattcggggttcagaccaaaacattcattcgctggacaacttccaagccctgtctctgtccttgatg

SEQ ID NO: 6189 - DNA, 284 bp, Zea mays
  misc_feature: Incyte ID No: 700351371H1
  unsure 154, 253: a, t, c, g, or other
caccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggangacctctatggccgcctcaaatcgctccaacgccacatggagttcgtcgaaatccaggaggagtacgttaaagacgagcagaagaactgaagtggaacncctcgtgcgcagaagaggtaagcggatcaat

SEQ ID NO: 6190 - DNA, 289 bp, Zea mays
  misc_feature: Incyte ID No: 700351373H1
  unsure 2, 4, 12, 15, 27-28, 35, 41, 67, 88, 90, 100, 107-108, 116, 152, 164-165,: a, t, c, g, or other
gnanggcaggangancgaagaccgagnngtgcggnggctcnggatgggaacgggacaggaccccaanatctcagatccttcctgcccncncgcccgtgcncgtcganntctcgttnttgccggccgcgcttacacctccgtgttatcctccnccagggggatcnnatacgcnacaggntacgcnatggtgctgtnagtctncgatanggttcactaatntagaaancgggcttngattcgaggacaaaatctcgatttcntgaggggnanaggcncnnttttatttntt

SEQ ID NO: 6191 - DNA, 290 bp, Zea mays
  misc_feature: Incyte ID No: 700351374H1
  unsure 2, 76, 263, 284: a, t, c, g, or other
anaattggttactgccaccacacgtcgaaattctccaaatagtatagattccaagattcatcacaacaatcttatncaacaatattctggcaaagatagaaggtaatcttgcccaggctgaggatgccattatgctagataaggatggctttgtatcagaaacaaacgcaacaaatatttttatggtcaaaaagggaattgtattgacacctcatgctgactattgccttccaggcattacgcgagcaactgtcatggatccngtggtgaagaaacttgtggtnacatga

SEQ ID NO: 6192 - DNA, 265 bp, Zea mays
  misc_feature: Incyte ID No: 700351380H1
  unsure 165, 174, 177, 179, 192, 207, 209, 255: a, t, c, g, or other
tccctccatcctctgcgactgcgtgcgtctctcgagctcgagtcgattgatgattcatcttcctagtctcgtctccgcgccattctccaaatccatctatcgtcaccatcccgatcacagccccagacccgatgcagcaacagcaggacccagcacccgccgatnccgacccantgncngccccccgacctngtgatgccgccggcntntccgaaaggagaggatcccttccggaaaggtttcctccaagtaagntttgtaaggg

SEQ ID NO: 6193 - DNA, 284 bp, Zea mays
  misc_feature: Incyte ID No: 700351382H1
  unsure 78, 186, 189, 195, 204, 207, 219, 241, 249, 253, 262, 265: a, t, c, g, or other
ctggcgaagttctccaagaaaagtgctcttccctgtgatatatgtctgcgatgtgatacaatattgaaccgtattttngtttgctcgagctgtaaggctactgtacacttagattgctaccagagtctggtgtatcccactggcccatggaaatgtgaactttgccatgagatgccctcagattcngtnacctcnggtgaaaantcngcccaaaagggncgaaagcttgtttggtgaatgnggtttatnccanggaacatcnggngttttagaagactgtgaag

SEQ ID NO: 6194 - DNA, 285 bp, Zea mays
  misc_feature: Incyte ID No: 700351383H1
  unsure 17, 19-20, 28, 31, 62, 197, 201-202, 205, 216, 242, 244, 246: a, t, c, g, or other
gccggtggaagattctngnntgccgtgnggntgaacttcagcgcccgagtcagtcccagctnatcctccccagtttaccactttgttctaataggagatgggaacacgagaagtttgatggctttgccctgggctgggaatacctcacccacgcccagttccagaaaggcctccagctgagcagacggccccgatcncgcnngancggcttttgcntccagccaaagaaccaccgtcaacangnanacctccaactgggaatcccaggctgggcttcgcacggag

SEQ ID NO: 6195 - DNA, 235 bp, Zea mays
  misc_feature: Incyte ID No: 700351387H1
  unsure 3, 33, 37, 45-46, 67, 93, 112, 127, 130-132, 137, 148, 155, 167, 179,: a, t, c, g, or other
gangcactgtcgagcgagacgcctcgtgggganattngcatcagnngggacaccttgttctcgggancctacaagcgagaggacctaaccaangaagtcttggtcgatggcnggttccacacagganacnnnggcgngtggcagtctnacggaanctgtggagcatngcaccgcaagantgccatccccaagcannaacanggaatnnacnngcagtcganatctggnganctcc

SEQ ID NO: 6196 - DNA, 279 bp, Zea mays
  misc_feature: Incyte ID No: 700351388H1
  unsure 81, 136, 143, 149, 169, 182, 186, 199, 204, 207, 219, 228, 236, 254, 260,: a, t, c, g, or other
cgggcataaaaggcttcgcggcccagggctcacttggcgctgagaacgcgggtccacgcgtgtgatcgtccgtgcgtctancctttgcccacgcagctttcagtcatggcctccggtaacgcgcgcatcggaaagncagcccntgactncaaggccacagcggtggttnatggcttttcaangagnaaactgtcggacnaaaanggnaattacgtggtnctcttttanaaccctcnggaattaaattggggggncccaanggagatccnccccnncnac

SEQ ID NO: 6197 - DNA, 285 bp, Zea mays
  misc_feature: Incyte ID No: 700351389H1
  unsure 3, 11, 14, 23, 26-27, 34, 38, 44, 77, 80, 87, 92, 103, 106, 110, 121, 125,: a, t, c, g, or other
ganggcaggangancgaagaccnagnngtgcggnggcncgggangggaacgggacaggaccccaaaatctcagatcnttnctgcccncacgnccgtgcgcgtnganggcntcgttcttggncggncgcgcttnanctccgtgtctctcctccnccagggggatnggatacgcnacaggntgcgcgatggtgctgtgggtcttcggctacggntccctnatctggaacnccggcttcnattcgatganaaaatcntcggcttcatnaagggctacaagcgcacttt

SEQ ID NO: 6198 - DNA, 283 bp, Zea mays
  misc_feature: Incyte ID No: 700351390H1
  unsure 75, 92, 159, 175-176, 206, 220, 223, 230, 253, 257, 261: a, t, c, g, or other
aaattggttactgccaccacacgtcgaaattctccaaatagtatagattccaagattcatcacaacaatcttatncaacaatattctggcanagatagaaggtaatcttgcccaggctgaggatgccattatgctagataaggatggcttgtatcaganacaaacgcaacaaatnnttttatggtcaaaaagggaattgtattganacctcatgctgacnatngccttcnggcattacgcgagcaactggtcngggntctnggggggaaaaaaactttgtgtt

SEQ ID NO: 6199 - DNA, 258 bp, Zea mays
  misc_feature: Incyte ID No: 700351396H1
  unsure 174, 206, 238, 240, 254: a, t, c, g, or other
tccctccatcctctgcgactgcgtgcgtctctcgagctcgagtcgattgatgattcatcttcctagtctcgtctccgcgccattctccaaatccatctatcgtcaccatcccgatcccagccccagacccgatgcagcaacagcaggacccagcacccgccgatcccgacccantgccgccccccgacttcggtgatgccgcggcntggtcggaaacgaagaggatcctttccggaangncttcttcaaggtangttt

SEQ ID NO: 6200 - DNA, 303 bp, Zea mays
  misc_feature: Incyte ID No: 700351401H1
  unsure 245, 254, 265, 281, 294: a, t, c, g, or other
tgaatggttttgatggtacagatacacattactttcacagtggtccacgtggccatcactggatgtgggattctcgcctatttaaactatgggaactgggaagttttaagatttcttctctccaatgctagatggtggctcgaggaatataagtttgatggtttccgttttgatggtgtgacctccatgatgtacactcaccacggattacaagtaacatttacggggaattcaatgagtatttnggctttgcnaccgatgtagntgcagtggttaacttnatgctggtaaatnacattccag

SEQ ID NO: 6201 - DNA, 100 bp, Zea mays
  misc_feature: Incyte ID No: 700351403H1
  unsure 15-16, 23, 55, 58, 67, 93: a, t, c, g, or other
cgtatattgagggcnntgtacanacagtcaatcctggtaatgctcccttggtacntgngcaacttcnggatgatgaatgcccggacagattgncataccc

SEQ ID NO: 6202 - DNA, 295 bp, Zea mays
  misc_feature: Incyte ID No: 700351405H1
  unsure 48, 57, 88, 124, 178, 277, 280: a, t, c, g, or other
ctttactccatcatttcaccagcagctgaaaaattttgctcttctgtngcatacaanaagaagattcagtatgatgaagctacttctncttcttcctctagcctgcttggtttcttctgcagangaaccgttaccgttttcaggccaattgaataccatcttcctagcagccaaatcngtggattctataaaagaagatagtcaagcaaggatactgatgcgtgaggttaatttttttaacaaatacaccctcatgagtatgacattcatgtaaganganacgggacatgccaat

SEQ ID NO: 6203 - DNA, 297 bp, Zea mays
  misc_feature: Incyte ID No: 700351406H1
  unsure 31: a, t, c, g, or other
cacgccgtcgctagcgcctgccgcggcgaanttctgtccctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatca

SEQ ID NO: 6204 - DNA, 300 bp, Zea mays
  misc_feature: Incyte ID No: 700351407H1
  unsure 14, 60, 66, 73, 84, 100, 106, 116-117, 132, 134, 136, 140, 144, 160, 167,: a, t, c, g, or other
tggcagaagctccntaacggccgtgtcgccctccattgaccatggagctgtgaaatcttncgtgancccttancgcatcttacnagccttccacagttcnacctcnctcactgctnncacactaggcttgcntncnccangccntatccaccagcacgantggaganactgangcacgatncnganccattcagaaacccgatttgntggacacctccgattncgctagtacttaatcccaattacatcnacaagaattgtcctctaagtctagggaacgtaatctgatcgtntgggtgg

SEQ ID NO: 6205 - DNA, 297 bp, Zea mays
  misc_feature: Incyte ID No: 700351408H1
gggaaaacaagccgtcggttctactcccggaaggtgtcgccaaaggtctcctccagcacctacaacatagcgcaggtttcatatgagctgaatgtcttgggtactcggggccctaggcggatgaactgtgttatgcactccatccctacctcgtgccttgaggctggtggcagtgttcccagccagctggacagcatccttgctcgctccactgatgagtcatttggcagcatttccttctccaaatcatctgttgtggaccggtctatgcgtttcagcagctcaagattctccgac

SEQ ID NO: 6206 - DNA, 294 bp, Zea mays
  misc_feature: Incyte ID No: 700351410H1
acggcgcccaagtccgacgatgtctacctcaagctcctacgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgaccgacgacaagaggatcagcgaggtgccggcgatgaaggtctgcgcgctcaggttcatgagacagcgagggccaggatcatcatgctggcggagatgcctcacttcgaccagct

SEQ ID NO: 6207 - DNA, 296 bp, Zea mays
  misc_feature: Incyte ID No: 700351411H1
  unsure 143-159, 291: a, t, c, g, or other
cagatccaccccatacctccgcggcgccaccccttcccgctccttctagccggcgtcggcgcgggccggagatctgttttctccggtaggaaaaatcctattgcgatctaaatatgggttcgaaatcggtagacgaggtgctnnnnnnnnnnnnnnnnngagtccattactccgcactccgtctggacggccaggcttccgcaacgacgtctggcctggagaacggccaccaggagccctttgtcattggtgttgctgggggtgcatcgtcaggcaagagtaccgtgtgcnagatg

SEQ ID NO: 6208 - DNA, 295 bp, Zea mays
  misc_feature: Incyte ID No: 700351413H1
ccgaagtgttcagagcgtattccttcggggaaatcatgtcgttggaagatctgtttgcacgagcttcaccaccaatctgtgcggagtggttccctaggcactcatctttggcctttgggcacctgctgaggctcctggagagaggccctctggattaccagcgggtggttcttctgatgcttaaatcgctgctgcagcaaacccctgtggatccgtcacagataccccaggtgtacaacttcgtgtcgcagctggtggagagcacattatgctcggaggcgctgatgtgctggag

SEQ ID NO: 6209 - DNA, 298 bp, Zea mays
  misc_feature: Incyte ID No: 700351415H1
cgcgcctactcaaccgaggccaacaagtcaaggcgagtgcggagtagaggcacaaggtcggatgcctagagagatttcccggtcgcctccgccattccgccggcgaggctcccctcctctgcggtacgtagccggagaaacagacgagatcggagccgctccccttacgcctctcggcgaaaaactcgttctccttctccactatgggacaggagcaatcaccaagtccaagaaggcatagaagcccactatctccaaggagacacagaagacagagaagtcggagcactacaattca

SEQ ID NO: 6210 - DNA, 299 bp, Zea mays
  misc_feature: Incyte ID No: 700351416H1
  unsure 11, 17, 35, 38, 40, 42, 59, 75, 199, 202, 205, 275, 282: a, t, c, g, or other
gagttcaccgnccatcnattggcgacagccgaatnccnanancccctctccgacgccgncacagcctggggcaantcacggacggagatctctgcggagtaacccgtttgtctgctttccttcgtattggttactagtctgttgctatggggaaattccagagaacaagaagggttcgcgggaagcgaaggaggacaanaanttngcgcttggggtgaagaggaagcagctgaagaggaagaggacagattgttggaatgtgccgtcgtagcgancccgtgncgggcatggcgttaaga

SEQ ID NO: 6211 - DNA, 299 bp, Zea mays
  misc_feature: Incyte ID No: 700351417H1
  unsure 48, 121, 292: a, t, c, g, or other
ccctataccttctgcataatgaattaactagaaataactttgcaaggngagccaaagctaagacccccgaaaccagacgagctacctaagaacagctaaaagagcacacccgtctatgtanccaaaatagtgggaagatttataggtagaggcgacaaacctaccgagcctggtgatagctggttgtccaagatagaatcttagttcaactttaaatttgcccacagaaccctctaaatccccttgtaatttaactgttagtccaaagaggaacagctctttggaactaggnaaacctg

SEQ ID NO: 6212 - DNA, 296 bp, Zea mays
  misc_feature: Incyte ID No: 700351418H1
  unsure 32, 113, 116, 272, 290: a, t, c, g, or other
ctcgttcagtggcaagagtttgctggccagantcctgactgtcttgagcatctggctgccagctacaggcacaggctcttctgaactttgagcagctggaacagatcctgtanagnattccccaggtgaagtatatatgcctggatgtggcaaatggctactctgaacactttgttgaatttgtaaaagatgtacggaagcgcttcccccagcacaccatcatggcagggaatgtggtaacaggagagatgttaaagagctcatcctttctngggctgacatcatccaangtggga

SEQ ID NO: 6213 - DNA, 293 bp, Zea mays
  misc_feature: Incyte ID No: 700351419H1
cgccgctctgttcctccgtcccctcctccttccggctctcgctgtcacatgtcgtgtggtgtgggggcgctctgatccggatggtgcagcgccgcgggatcgcccacggccatgattgatcgcgaacgagcagaggaaatgcaagttaataatgaggcaccactagggtgcctcaagccaaatatttctcagtataactctccagagcagataggtggtgttgaagggtttcctgagaataatgaaaaaaggaatgatattgttgctgcagaaaaaatctgggaggcgactcc

SEQ ID NO: 6214 - DNA, 293 bp, Zea mays
  misc_feature: Incyte ID No: 700351421H1
atcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatg

SEQ ID NO: 6215 - DNA, 297 bp, Zea mays
  misc_feature: Incyte ID No: 700351424H1
  unsure 4, 10-11, 27, 33-34, 39, 72-88, 114, 263, 274-280: a, t, c, g, or other
accngctttnnccgcctcccctccccncccgcnncctgngcctccataccccacccccccgcaggagcggcnnnnnnnnnnnnnnnnnaaagccaaaggcaagatgttcgggcncgcgccgaagaagagcgacaacaccaagtactacgagatcctcggggtgcccaagtcggcgtcccaggacgacctcaagaaggcctaccgcaaggcagctatcaagaaccaccccgacaagggcggtgaccccgagaagttcaaggagntcgcacaagcnnnnnnngttttgatgatccagag

SEQ ID NO: 6216 - DNA, 285 bp, Zea mays
  misc_feature: Incyte ID No: 700351426H1
  unsure 47, 88, 123, 195, 238, 241, 270, 274: a, t, c, g, or other
tcatatctgatgataagttgtgggaccagaatgcctttaatgatctngtacgcaaaaaatttggacagccagttcaaggagatgatcntgtatattgttatgatgggaaactgaagctgggantgctaccggcaagtatattttgcagcggccatacatattttgtgcagggcatgtataagcagcttcattggnaccatatgctgttcatactacttttcagtatgcgggtactganggnaagcgccatagattgcgagaggcaatgcnttcntgatcaccatc

SEQ ID NO: 6217 - DNA, 293 bp, Zea mays
  misc_feature: Incyte ID No: 700351430H1
  unsure 18, 140, 185-212, 241, 267: a, t, c, g, or other
ctcgagcggttcggcggngggcgaagatctcccaacccacattgcgcgcgcgtctacgcccgaggatcgatggttggcggcggggggcgccgcgcggcgtggggcgctggtgcctggtgatcctggccgtggcctccgcnctaggggtctctggccccgccttctactggcgctacaagaagggnnnnnnnnnnnnnnnnnnnnnnnnnnnngcggcggcggtggcttcttccccgtcgtncctccctgcagctgcgactgcccggngcccctttccctcaagtccatcgccc

SEQ ID NO: 6218 - DNA, 111 bp, Zea mays
  misc_feature: Incyte ID No: 700351431H1
  unsure 10, 25, 30-31, 34, 39, 41, 58, 68, 70, 84, 86, 97: a, t, c, g, or other
cccacctcangccgctataaggcanatgtnnaanacaangntggaaccaaacgactgncattgacggncnaagtagactttggnanctcagagagcntaagaggacgtgtt

SEQ ID NO: 6219 - DNA, 291 bp, Zea mays
  misc_feature: Incyte ID No: 700351432H1
  unsure 234, 242, 263, 280: a, t, c, g, or other
gcagaggggtccatacggcgttgttctggattcccgtcgtaacttaaagggaaattttcacaatgtccggagcccttgatgtcctgcaaatgaaggaggaggatgtccttaagttcctgcagcaggaacccacttaggtggcaccaatcttgacttccagatggaacagtacatctataaaaggaaaagtgatggcatctatatctaaatctcaagaggacctgggagaagctnctgctggnagctcgtgcaattgttgcctngaaacctgctgatgtcntgtaatatctc

SEQ ID NO: 6220 - DNA, 289 bp, Zea mays
  misc_feature: Incyte ID No: 700351433H1
agaagacttaggaagttggggacatcactgtgacccatcaactgtacctgatactatactgcagtgttctgctggcgaagaggtttcttttgttttcaccaatcaggttgacggaaaacttgttccagttgaatctatggtgcgatcagcagctcatcaacaaaacggaatagcagccaccggagaaaaaggagtgcagatacccaaatctcctagcaaacctggaaagcaatccttaaatggcaagaatttgaagatgggatttcattaaagattcgtctttgaatgg

SEQ ID NO: 6221 - DNA, 285 bp, Zea mays
  misc_feature: Incyte ID No: 700351434H1
caattattgtggtgaatttgataatgctggtgcaatgatgagtgtcgatgaaactttgatgtgctcattccaaattctgaaacctgctgagagaaaaaacaaatttatggggtccaacaaaatgtgatagtgaaagccattttgcttccagcagctctagcctcttaaggttctcctgtggatgcatcgagacaacagcatgctggcgccaagtttgagggcagcattgggctactatcagagaaaccaaataatcccatacctaactgttcatctggaattatc

SEQ ID NO: 6222 - DNA, 285 bp, Zea mays
  misc_feature: Incyte ID No: 700351435H1
  unsure 23, 38, 82, 84, 105: a, t, c, g, or other
gcactcgcacctctttgccgttntccttctcccgttcncctcgcgccgccgccgacctacgccagttgcacaggtcttcgtncnccgctttccggcgaagagcantcgcgcgagggaggggatggggaagaagcagaagaagcctgggaaggggaaggagaagacggagcggaagacagccaagggcgaggagaagcgtgcccgccgggattcccgcaaggtcggcgaggaggacgacatcgaagccatccttaggagctacagaaggaagaagcgaagaaggag

SEQ ID NO: 6223 - DNA, 247 bp, Zea mays
  misc_feature: Incyte ID No: 700351436H1
  unsure 26, 64-65, 67, 74: a, t, c, g, or other
tgcggcaagtgttgaccatggcggantaaagcggttgtcggagagccgtgacctgacgcggatnncncgcatcngcgcgcactcccacatccgggggctagggttggactcgtccatggaggcgcgcgatacctcggagggcatggtcgggcagctccacgcgcgccgccctacggggctcatactccagctcatccgccagggcaagatcgccggccgcgctgtgctccttgcgggccagcccggc

SEQ ID NO: 6224 - DNA, 284 bp, Zea mays
  misc_feature: Incyte ID No: 700351437H1
aagtaagctcaagggacatcagaagaagattacggggctggccttttctcaatacaatgaacgtgctagtatcatacaggtgctgatgctcagctatgtgtgtggagtattgatggctgggaaaaaaagaaatcaagatatatccaacccccagcaaaccgacctggcactttggttggtgacacaagggtgcagtttcacaatgaccaaacacatcttttggtcgtccatgagagccagttgggaatctatgatgggaatcttgactgtttgcgcttgtggtc

SEQ ID NO: 6225 - DNA, 286 bp, Zea mays
  misc_feature: Incyte ID No: 700351439H1
gcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgttcagaggaattggcaggtattcccgatctgccatgtattccagaaaggccatgtacaagaggaagtactcagccgctaaatccaaggttgaaaagaaaaagaaggagaaggttctcgcaactgttacaa

SEQ ID NO: 6226 - DNA, 279 bp, Zea mays
  misc_feature: Incyte ID No: 700351440H1
  unsure 17, 22, 43, 86, 168, 175, 222, 229, 240-241, 243, 245, 258, 262, 269, 277: a, t, c, g, or other
gagccctcacttcaganctggnatcatgtacgcgtccagtgantcttccgacgagccgcttttgaagtccaacatgttctctctcngtggctccaagttcttcggcgcagtcagtagaagcatcaacctgggtgggcagagcgctcttgctctgcgtctgctcctcgntgttttntcgtctaaaattgcttccagtgcgaaccggccgtttggagaagagtnccgggcnagctagaaggnntncnaaagatatggatncagntgttctnggggagcncc

SEQ ID NO: 6227 - DNA, 282 bp, Zea mays
  misc_feature: Incyte ID No: 700351441H1
tgaagacaaagaagacctgggctcagttctgctttttctcccggcctaacaaaagaaagcacgaccgaatagacaccgcgtcgtgattcactgtgagactgatgaacattaagctgctgtttcctcaactctacacttctgaagagaactatcgggtgcatcgccttcgatcgctaccattgtgttgtatgggtcaacaagatgtgatgcccagaagcttttccttggacaatgctgcagcctgcagcttctaacctgtagaaccaagatggtcaggtttca

SEQ ID NO: 6228 - DNA, 281 bp, Zea mays
  misc_feature: Incyte ID No: 700351443H1
  unsure 3, 19, 145, 226, 235, 244, 262, 272: a, t, c, g, or other
cantactctaaccttcaanaccactataagccctaaaagtaatgccaacacagagccaaatatattaccttctataacagctccaaaaacttctctaagtccactgtctgtaaaaactgctggggagtctggagatttgcctacnttaaccatgaagaacagacagatggtcagtccatgccatctttggggaacataagaggacgggtgctttctctgcagaacnagggtggcntatttgagnctcgacaaatcgtctttnattctgaacntccaagcct

SEQ ID NO: 6229 - DNA, 279 bp, Zea mays
  misc_feature: Incyte ID No: 700351444H1
gaggaactgaagcagaaatctggaagatgtgtgtctgctgtagaaaaggctaacgtggaactggagcatggtatagacggtggtcaagctccagacgaaaagtgtgatcatgcctcagcgaaagtgcaaaggctcctccaagcaagggcagggaggcagacgaaactgcggatacagataaggaagcttttggttctaggacagagaaaaccaggaggaggttacagccagctgctgctatgttgctcaggattcatggcgctgacttgatgcggataa

SEQ ID NO: 6230 - DNA, 280 bp, Zea mays
  misc_feature: Incyte ID No: 700351451H1
  unsure 230, 268, 273-274, 277: a, t, c, g, or other
gccgcctcaccgcctctctcaatctgataccgcagatccgtcgtccggtgagtggaagccgcacgaacccatggcctccggcgagcttgcctgcacctacgccgctctcatccttcagcgacgatggcatcgccatcaccgccgagaagatcgccacgatcgtgaaggcggccaacatcaaggtcgagtctactggccggccctcttcgccaagctctggagaaagcgcnaacgtcgaggacctcatctctccgttggatctggtggnggagnnctncaa

SEQ ID NO: 6231 - DNA, 273 bp, Zea mays
  misc_feature: Incyte ID No: 700351453H1
gcgacggcaacgactggggcgaccgtcgctgccgccctacttgccggttgctcggatcttcttcggcccgttagccgtcgacgagcaccaccagggcaaccagatacttcagtggcttcgcaaggatgtcctggtgcactattgagtctgatcctggtgtgttcactgagctgattcagcaaatgcaagtgaaaggtgtacaggtggaagagctttactctctcgatgtgggctctcttagtcaactgcggccagtatatgggctaatttttc

SEQ ID NO: 6232 - DNA, 273 bp, Zea mays
  misc_feature: Incyte ID No: 700351454H1
  unsure 131: a, t, c, g, or other
ggaccactgtcctctgctgaacttatcagccaagatgaggcaaattatgtgatggagaggtatgggacaaagttcatggatgagtaccaatctatcatgaccaaaaaactgggcttaactaagtataatangcagctaattagtaagctgcttagcaacatggcagttgacaaggttgactataccaacttcttccgtcttctttcgaatgtcaatgcggatcctggtattccggagaatgagctgcttgtcccactgaaggctgctctccta

SEQ ID NO: 6233 - DNA, 268 bp, Zea mays
  misc_feature: Incyte ID No: 700351457H1
  unsure 123: a, t, c, g, or other
ctgcagcttcgataagatggctgagtatttcaacaggaagtcatgcttgtccgagacagtacctctgggttccttcaactctctcttcagcttcaccggttcatggaagaatgatgctgcggncacgaaggcccttgcgattgatggctattctctgcctctgtttcgagtgaaaattaggagttctgaactgacgctgcttgagagcgttaagcacgcgatcccaaatgtttgggatccatcagcatggctagctttattgagaata

SEQ ID NO: 6234 - DNA, 270 bp, Zea mays
  misc_feature: Incyte ID No: 700351458H1
  unsure 60, 257: a, t, c, g, or other
ctttctctcaggaagttaaccaaggagcagctgcagccacttatcgataggcttgcggangctcttacctaattggagggccgacttgatgtctcatgctggcagagctatccaggtgcagcatgtgctcacggcaacagttatatatcacgccatggctttggatctgcctaagtgggctatcaaagctattgacaagattagacgtggctttatttggaaaggtcgaaaggatgtgctcggtggccactgcttanttgcttggggcaa

SEQ ID NO: 6235 - DNA, 267 bp, Zea mays
  misc_feature: Incyte ID No: 700351459H1
acggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgcctggtacttgcccttggatccaagccgattctccctgagtagcttccgtttgacttctgtgggacgcatgattacccgcacaatggtcaaggcccgga

SEQ ID NO: 6236 - DNA, 253 bp, Zea mays
  misc_feature: Incyte ID No: 700351460H1
gcatcgccaattcaactccgcatctgaatcggcactcggcagcgcgccagtcccatagtgtaggaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccg

SEQ ID NO: 6237 - DNA, 274 bp, Zea mays
  misc_feature: Incyte ID No: 700351462H1
caataatgtctattactgtgtgggaactgcatatgttatacctgaagaaaatgaaccaaccaagggccgaatccttgtatttgcagttgaagatggaagtttgcaattaattgtggagaaagaaaccaaaggagcagtttattcgttgaatgcattcaatgggaaattgttggctgctatcaaccagaagattcaattatacaagtggatgtcgcgcgaggatggttcacatgagctgcaatctgagtgtggccaccatgggcacatacttgcc

SEQ ID NO: 6238 - DNA, 276 bp, Zea mays
  misc_feature: Incyte ID No: 700351463H1
ccgtttagcgaatcactcaattcccaaaatttatggtgccatgaagcctactgctgtatttgttcctctagaagaaattctaaaaagtgggaacttcgagcttgtgacaaaggagatatttggtccattccaggtagtcacagaatactctgaggatcagcttgagttggtctagaagcctgcgaaaggatgaatgcgcatctgacagctgcagttgtctcaaacgacccgctattcctgcaggatgtacttgggagatccgttaagggacaacct

SEQ ID NO: 6239 - DNA, 274 bp, Zea mays
  misc_feature: Incyte ID No: 700351467H1
  unsure 2, 4, 43, 65, 111, 121, 183, 196, 214, 244, 263: a, t, c, g, or other
gncnccagtgccccaagccaggtgtcatcctcctaaccaaganaggccggcagatcctgtgctgnccccaataagaagtgggtccagaaatacatcagcgacctgaagctnaatgcctgangggcctggaagctgcgagggcccagtgaacttggtgggcccaggagggaccaggagcctganccagggaaatggncctgccaccctggaggcnacctcttctaagagtcccatctgctatgcncagccacattaataacttnaatcttattta

SEQ ID NO: 6240 - DNA, 264 bp, Zea mays
  misc_feature: Incyte ID No: 700351468H1
  unsure 46, 61, 79, 95-114: a, t, c, g, or other
ctttcctctacgaaaaaaccatttttcagtataaaatttcgttttnctcctctcagtctcngacgccgccgcactcatncccccagacgaccacnnnnnnnnnnnnnnnnnnnncacctcgccggaaccctagcgccgaccgcctgccgtgcccatcgacggcgatcgcattgctgcgccccgatggcgacccgcgcctccaagaattgcctctgcgcgggcagctcttcgttcgatgaccccgatgtggtcgaggtgtctccg

SEQ ID NO: 6241 - DNA, 215 bp, Zea mays
  misc_feature: Incyte ID No: 700351469H1
  unsure 65-95, 191: a, t, c, g, or other
ttcttagaggataaggttgtcctagcggagagggagctagccaggatttcggttgagatcaagannnnnnnnnnnnnnnnnnnnnnnnnnnnnnncgcgggaaggtgcagctgaagcggatcgagaacaagatcaaccgccagtgaccttctccaagcgccgcttcggggctgctcaagaaggcgcacganatctccgtgctctgcgacgccgag

SEQ ID NO: 6242 - DNA, 270 bp, Zea mays
  misc_feature: Incyte ID No: 700351470H1
  unsure 218: a, t, c, g, or other
gtcggattgataacttcattgatggtctatctgctctgctggacgagctcaatgaagagacttttgagcaccatagaagtggtttaatagctgataaactggaaaaggaaccttcacttagctaccaaactagtgattattggtctcagatcgctgataaaaggtacatgtttgatatgtcaaaactggaagctgaagagctctaagacagttcaganggctgatgttatagcttggtacaacacatacataagatcatcgtccccaaag

SEQ ID NO: 6243 - DNA, 269 bp, Zea mays
  misc_feature: Incyte ID No: 700351471H1
gggaatcggaggagaaagcaaagcttcttgttgaagagagagatcgcttgcttacagagagagattccgctgcttcaagaagctcagatgtggcgctcggagctaggaaaagctagaggaaacgctgtaattctagaagcggctgttgtcagagccgaagagaaagctagggtctcagcagcagatgctgacatccgcataaaagaagccatgaaccgacttgagtctgccaccaaagaaaaggaggatctcctagccctgtggatgct

SEQ ID NO: 6244 - DNA, 267 bp, Zea mays
  misc_feature: Incyte ID No: 700351472H1
  unsure 49, 113, 185: a, t, c, g, or other
tccgaacctagccaaccagccccagcgcccaacgcacgaactgtaaganaccctagcggagaaactgacacactcgcctacatcctcggccgccagctcgccaccatcgcctnccggtcggccgcgccacctcccggaagattggataacaatatcatgccattaggtggataacacttgacgtnctcctggtttgttcatttccgggcatcatcaaaatgtcaggaccgctgaattcaaacattagtgggggcccctcgaacctta

SEQ ID NO: 6245 - DNA, 267 bp, Zea mays
  misc_feature: Incyte ID No: 700351477H1
  unsure 2, 4, 8, 19-20, 42, 54, 71, 89-90, 98-99, 101, 113-115, 120, 122, 124, 129,: a, t, c, g, or other
gntngagnactgcagtgtnngtgactatattcaacacagtgnacactagtctgnatgtataccgaaataangatgccttaagccatttnntaattgcnngngctgtcacgggnnntcttntnangatanacgtangcctgcgtggccgncgtggctggtggcanaattggaggccttgctnggcactcctgtaggaggcctgctgatggcatttcagaagtanctggtgagactgttcangaaatanaacagaaggntcgaaaggca

SEQ ID NO: 6246 - DNA, 270 bp, Zea mays
  misc_feature: Incyte ID No: 700351478H1
  unsure 3, 35, 37, 54, 58, 71-72, 81, 83, 89, 108, 160: a, t, c, g, or other
gcntcgccaagcccttggtgagaggattaggccantncttaccgtgaacaagangganaggtgcttccttnngcttcaggntnagggtnaggaagcttatcagacttnctcccgtgttattgagaatgccaatgtcatcatggcaacatatgaagataanctccttggtgatgtccaagtatacccagagaaggggacagttgccttttctgctggtctgcatgggatgggcctttacactcactaactttgcgaagatgtatgcatcta

SEQ ID NO: 6247 - DNA, 279 bp, Zea mays
  misc_feature: Incyte ID No: 700351480H1
  unsure 182: a, t, c, g, or other
agttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaanccatttgttgctatcggggactacaatggccacgtcggtctgggtgttaagtgctccaaggaggtggccaccgccatccgtggggccatcatcctgg

SEQ ID NO: 6248 - DNA, 265 bp, Zea mays
  misc_feature: Incyte ID No: 700351483H1
  unsure 9, 88-117, 146: a, t, c, g, or other
cggcgggangccatgaagggggtgatgagcggtgaggtggctgcggctggagggcgcacgggacaggctgctagagaggtgctgtttnnnnnnnnnnnnnnnnnnnnnnnnnnnnnnaggaagcgcgaagaagagaagagggaganggagaaaggcgaggaagttgggagggaattcgttgcacatgtgccactacctgatgaaaaggagttgagcgcatggtattagagaggaagaagaaggagctgcttagcaatatgccagc

SEQ ID NO: 6249 - DNA, 264 bp, Zea mays
  misc_feature: Incyte ID No: 700351484H1
aggaattcggtatagaagatgcacacctagaagatatcatccatgacgttgatccaggacaatgatggtcggatcgactacaacgagtttgtaacaatgatgcagaagggaaataacccactagggaaaaaggggcactgccagatgagctttggtcttagagaagcattgaagcttggctaagtggcatgatcaatcctgtgtgaagtgccattcggcttcatatgccaactttagctgatgaaactaatccgtgaatttggg

SEQ ID NO: 6250 - DNA, 267 bp, Zea mays
  misc_feature: Incyte ID No: 700351485H1
  unsure 57, 170: a, t, c, g, or other
gcttgagcaaggccttcaagtgcttaagattttcaaggatcatgtctgcaagacatnccatactggatgacttcggcttttatgataatcgtgagaagatgatgcaagagaggaaagccaaacagcagcagtcgctgaaaaaggtcattgatgtgaagctgcccagcgtncaccgacatggagagaagtcctaaaggagagactggatcaacagaagttactggggttgagactgacgtcttgaacaaagagcgtttattaggcaaa

SEQ ID NO: 6251 - DNA, 266 bp, Zea mays
  misc_feature: Incyte ID No: 700351486H1
  unsure 20, 120-121, 153, 156, 176, 183, 191, 216, 246, 249, 262: a, t, c, g, or other
ccgcttcctctgtctctgtntcgtcgtctcccccatctggccatctccggctagggtttgccctcccaccacgtccgaggtctagctcgtctccgccactgccggaccaaggatgtcgcnngagcaaggtatggaggagccgccgccgcaggntanagcgaggcacaatcggccgncgatgtncccatgancgaggccgcagcggtggaggatgtngatgaggaaacccgtcatgggggaggggcnggnggttaaaagcggnaccc

SEQ ID NO: 6252 - DNA, 267 bp, Zea mays
  misc_feature: Incyte ID No: 700351487H1
  unsure 21, 72, 149: a, t, c, g, or other
acctcgctctcctctaatggncgccgatgccgacgcagccgaggtggagcggctttacgagctcggcgagcnccctctcttccgccaaggacaagtccgagcttgcggcggactacgaggcgattattgcagcagtgaaggggcagagngtcaaggcgaagagcttcgcagcgcagttcattcccgaggttcttccggagcttccctgcactcgccacccgcgccatgtcggccatgttcgacctcgttgatatggaggagctcgcg

SEQ ID NO: 6253 - DNA, 262 bp, Zea mays
  misc_feature: Incyte ID No: 700351488H1
  unsure 139: a, t, c, g, or other
tgcacaggaagactcactcccttcatattcaaatttgcatggccaagttattcaagatacttcttctcttactctcttcaccaatagatggatgcggttgacacatgaagtaaaatcaggaaagagtggaaagctagantgtttgtctgtgaaggcgacaataagcaaacaccttgtgatttgctgccatgctgaaagccctgcttccatggaagacttcccattatggaaatttgagaaccaagtggagacactgcccaca

SEQ ID NO: 6254 - DNA, 262 bp, Zea mays
  misc_feature: Incyte ID No: 700351489H1
gaagatcaccagcaacaccaagcaactactcgtacgcggaaagagaaacccagaagccggtcttgttggattattccgttcgtcagttccgtccggagcggcggagcaaaaatgacgtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaag

SEQ ID NO: 6255 - DNA, 262 bp, Zea mays
  misc_feature: Incyte ID No: 700351491H1
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctct

SEQ ID NO: 6256 - DNA, 262 bp, Zea mays
  misc_feature: Incyte ID No: 700351492H1
  unsure 26, 53-54, 65, 70, 91, 95, 100, 107, 114, 127, 133-134, 141, 143, 154, 157,: a, t, c, g, or other
attacggatcactatgatcctaacantgcaacccacgataggagcaaggatgnnttgagcttggnaatgncctgccagatattagaagcantcgncaatntctccangcagtanaagacgccgggtntgaggnngtttggnanccaggatctgntgnagnntctccctgccttggtanntgcccgtggatccaagnnganncnccntgagtaggcttaccgtgnngacttctgtgggacgcatgattacccgcgcantngaa

SEQ ID NO: 6257 - DNA, 265 bp, Zea mays
  misc_feature: Incyte ID No: 700351493H1
  unsure 156, 192, 231, 234, 244, 260: a, t, c, g, or other
cagagcacctcgcctcattccatcccacgtcaagctagatctgccggctctaggcttagaacacatccggataatggtggatgcatcgttctttctgttcgtcgtaagcagttctttgtatcaagtgagatggcagtgtacgactcggtaaaattnaagctcaacagaccaaattcacaggtctctctctanatgagatcgatctgtatgccgattttcccgctgaactgngcnatctattttnctctggctatttgctnttcgg

SEQ ID NO: 6258 - DNA, 278 bp, Zea mays
  misc_feature: Incyte ID No: 700351496H1
  unsure 30: a, t, c, g, or other
gtggatgtggatgatgcagagcaggatgancatggttaaagagcaccgcaagcggaaagagtttgaagtttttgttgtggtctggataaagatgcaacagaaaatgaccttaagaaggtttttggtgaagttggtgagatcactgaagttcgtctgatgatgaaccctgcccacaaagaagaataaaggctttgccttcctgcgatatgcaactgtagagcaagcaaggcgtgctgtttcagagctaaagaatccactggtgcggggtaaacaatgtg

SEQ ID NO: 6259 - DNA, 93 bp, Zea mays
  misc_feature: Incyte ID No: 700351501H1
  unsure 50, 77-78, 80, 82, 85-87, 89-91: a, t, c, g, or other
aggccaagctttgaacctgatggcctgattcccttgtccagccagatccncaaagtctcgaattccacacaacatannancnggnnngnnngg

SEQ ID NO: 6260 - DNA, 297 bp, Zea mays
  misc_feature: Incyte ID No: 700351502H1
  unsure 78, 124: a, t, c, g, or other
gaagccctacgctacgcctaccctcgctgtactactagctgccttcctacccgcttcccctctcctcccgacgccgtntccctccctccctccgcctccgccgtcgccgccgggacacgcgaanttccaggtcttgtctttgggtagaacatgtcgtgctttgcgtgctgtggtgatgaagatacccaagtaccagacaccagggctcaatacccaggacaccatccagcgagggccgatgcataccgcccttctgatcaactcccaaggtctcagctgtgaaaatgcaaccatcga

SEQ ID NO: 6261 - DNA, 304 bp, Zea mays
  misc_feature: Incyte ID No: 700351503H1
  unsure 6, 25, 52, 57-58, 82, 87, 117, 125, 133, 137, 164, 191, 246, 286, 291, 297: a, t, c, g, or other
ggtggnctgaggattggtgaaagcngactggtagctgacaatggcatttctntgganntccaccatgcaaccttaacgccancgttncacgatctttgtggtcaaagttcaaatgtnaactgtgncctctcanggtnctgagcagtattgtggcagtgatcgtnatgctataaattctcagccgactgacncgggattacacccattcaggacattcctactagatgcacagcaagcagaatcttntactttgaatcctagtgaaaacccttgggtgatttttcancaatncaaganagcattg

SEQ ID NO: 6262 - DNA, 299 bp, Zea mays
  misc_feature: Incyte ID No: 700351504H1
gtaagcctcagttccgccggcgtgcgaggggttcgatctgggttagcctctcacgatgccgccagcccccaagtccggcgacgccctcttcgccagcgtggatcgcgtcaatgcggagtgttcacgctcacgtacggcgccatagtgcggcagtgctcacggatctggaggaggtcgaggaggtcaacaagcagctcgatcaaatgggttacaacattggaacacgattggttgatgagttcttagcgaatcaaatgtatcaaggtgtgttgacttcaaggagactgccgatgttattg

SEQ ID NO: 6263 - DNA, 292 bp, Zea mays
  misc_feature: Incyte ID No: 700351506H1
  unsure 32: a, t, c, g, or other
ccttggtgtttgtgtagaagtatcgccttgcnaagtatatacccgactctcctgctgaaggttccaaggacgaaaagaaagattcgagtgattccctctcgaacacggattctgcgccaggattgcaaatcaatgaggcactaaagatgcaaatggaggttcagaagcgactacatgagcaactcgaggttcaaagacaactgcaactaagaattgaagcacaaggaagatacttgcagatgatcttgaggagcaacaaaagcttggtggatcattaaagcttctgaggatc

SEQ ID NO: 6264 - DNA, 297 bp, Zea mays
  misc_feature: Incyte ID No: 700351507H1
  unsure 26, 28: a, t, c, g, or other
gcccatcctccgcatcatcgccagcngnagcgggcaagtcaatgtggattcagactccatatttcaggccctatggataagcaggagccagtagccaatgttgaacaaaagataggtctctctaggaagccaaaggagctggtcattactcattaccgaattattgttttttgtcctttttaccttgtttactctgtttgtctattttatcaaccatctaccttagcctatgccataaggatgagaatgcaactgtgcccttgatttcagttggttcaaatgctatcgatctaccaa

SEQ ID NO: 6265 - DNA, 302 bp, Zea mays
  misc_feature: Incyte ID No: 700351509H1
  unsure 201: a, t, c, g, or other
cttccctccgccggatccactgtctactttggtcctcatccccatccccgcacaccatcagtccccgcaaacatcacgctgacaaggaacatccaccgcgctcgccgccaacaacttctacaccatccaccggaggtgctggagaacatgcaggcgccggtcaagaaccccacgatcctcgtgatcgcgtcgaccgcgtantgcaggaggctgatgaagtgttgtttggcttcccgacgaggtacggcgccatggctgcgcaaatgaaggccttcttcgactccaccggctcatctgggagg

SEQ ID NO: 6266 - DNA, 300 bp, Zea mays
  misc_feature: Incyte ID No: 700351511H1
caggatggttcttgcagcatcaggagttgatcatgatgcgctgatttcagttgtagaaccacttctgtctgaccttccgtgcgtgaaacgtcctgaagagccaaaatcctgtgtacgtgggaggagactatcgctgccaagcagattctccaaacacacacatcgcacttgcttttgaggtgccaggtggttggaatcaagagaaaactgcaatggttgtgacagtgcttcagatgctcatgggaggaggagggtccttctctgctggtgggcctggaaagggaatgcatctcgattgta

SEQ ID NO: 6267 - DNA, 302 bp, Zea mays
  misc_feature: Incyte ID No: 700351513H1
atcatatgcatcctttggtctccatctcgcaatccaacagggtttgcatattcagaggatgcaggtgagggagctgatgaggaagggctctctctagtaggcagtgcggtgaaaggaaccggagatatggtaaacatgcatatctttccggaggacaagcgtgcatgataagttttggcctgaatgcagctgtactcctggcagaatgctatgtgaagtacctttttcctctggattcacgacttagctgacatcttctaaagattgcgtaagattccagatgtacaggtggtgacttgtgt

SEQ ID NO: 6268 - DNA, 122 bp, Zea mays
  misc_feature: Incyte ID No: 700351514H1
  unsure 39-40, 48, 69, 85, 91, 95, 103, 105, 108-109, 116-117, 120: a, t, c, g, or other
aggcatgaacccctaaaccagggggcccctctccaggcnnctccctanatggaccctcccgggccctangcccatggtggatttncacttncccngcaacaancngcnngcaggcnnggncg

SEQ ID NO: 6269 - DNA, 300 bp, Zea mays
  misc_feature: Incyte ID No: 700351515H1
  unsure 12, 26, 124, 127, 132-133, 135, 142, 151, 239, 288, 291-292: a, t, c, g, or other
cttccctttgcnccgctctcccccancctcgctcgccatataatacgggccggccggcggcaagctgggtccccgcggatgggctcggtctcgcgaggctagggtttggtcggtcgtctcgccngcntcganncncccagcnctgctagcncgctctctcgcgttagggttccccgtagccatggtgctgcagcgcttctcgtggccgtacggggccggagcgccaccttctgcggtanttcaccgggtggagagagtgtcccatggggctggtcggggcgtgttcangtnntcttcgat

SEQ ID NO: 6270 - DNA, 298 bp, Zea mays
  misc_feature: Incyte ID No: 700351518H1
acacgctcctcacctcgcggcgactcttgccaggcattcctccgcgaaaaacgcatccgctccaaggggagttgatcgagaagcgttggtggacatgggtcagatccagtactccgagaagtacttcgacgacacctacgagtacaggcacgtcgtcctcccgcccgaggtcgccaagctcctccccaagaaccgtctcctgtccgagaacgagtggcgcgcgatcggagtgcagcagagccgcgggtgggtgcatacgcgatccaccgcccggagccgcacatcatgctgttccgcc

SEQ ID NO: 6271 - DNA, 297 bp, Zea mays
  misc_feature: Incyte ID No: 700351520H1
  unsure 133-178: a, t, c, g, or other
gccaggcctgcacccaaagcttccggagaattcctcccttgccccgccgtcgcatcctcttcgaagttcgaatcgaatcgcgccgcgatcacccacctcatggcggacaaggagcctgtcgtggagcggccannnnnnnnnnnnnnnnnnnnnnnnnnnnnnnnnnnnnnnnnnnnnngggaggaggaggacacgggcgcccaggtggctcccatcgtgcggcttgaggaggtagccgtcaccaccggcgaggaggacgaggacgtcctgctcgacatgaaggcgaatgtaccgatt

SEQ ID NO: 6272 - DNA, 301 bp, Zea mays
  misc_feature: Incyte ID No: 700351521H1
  unsure 2-3, 28, 51: a, t, c, g, or other
cnnggctccgccgcgattcccatccccntccccgccttgccgttgccgttnccggcccccccggttctcccggagctttctttctggccggcgcagtagagaagcaagacagaattgcggcggcgcctgcccgcgcaaaggaaataatcagcactgtttgccaaaggcagctcctgacgcatggctagtacttaaggatactttatgtgcagtgcagaccatgaagatagatgacgaaaggccttaccaaactcatatttttcatgatcttgcatctaacggcagtcctaaattagactgt

SEQ ID NO: 6273 - DNA, 290 bp, Zea mays
  misc_feature: Incyte ID No: 700351522H1
  unsure 238: a, t, c, g, or other
ggagatacacctacccattgctcgaggaggccggattggaggcttgggctgtggacatccttgggtggggcttctctgatttgggtacgccccatcctgcacaccatgtgatctgaaacacggccgccatgtgatgttgcatccaaacgcgagcatttttaccagttctggaaatcatacatcaaaaggcctatggtgttagtcgggcccagccttggtgctgctgttgccatgattnttcagtcaactaccccgaagcggtctcgaaatgatctcatggtgcaatgtat

SEQ ID NO: 6274 - DNA, 288 bp, Zea mays
  misc_feature: Incyte ID No: 700351523H1
  unsure 49, 252: a, t, c, g, or other
gcctctcctcctctcctcccccacccgtccatcgcccctccctccggtnctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcanagcactacgctgacctttccgacaagcctttcttcc

SEQ ID NO: 6275 - DNA, 298 bp, Zea mays
  misc_feature: Incyte ID No: 700351525H1
  unsure 41, 55, 66, 91, 122, 153, 155-156, 158, 160, 175, 180, 200, 205, 216, 222,: a, t, c, g, or other
tccaggaaaatcgcagagaatgagggggatcctcttcgggncccggcggcagcgncgcggcttccngctcttccccgccgccaagcgctcntcggcacccgcgaaccttcttttcgctcgcntctatcgcttcctcccggccagcaccatccnanngntngggtctcctcctcgnactcntctccctcatcccgccggcnttctnccacctccgtntccgcngcttccaccaaatgcgcgagangaagtgcgggtggatcgcgaggccacccatggtgtgcgcgcaggnggtgatcna

SEQ ID NO: 6276 - DNA, 299 bp, Zea mays
  misc_feature: Incyte ID No: 700351527H1
  unsure 6, 12-13, 17, 20, 23, 26, 31, 38-39, 42, 45-46, 57, 69, 81, 87, 93, 98,: a, t, c, g, or other
cacatncatatnntatngtnaanctnagatnattaaanntcnaannggtcatctaantcctcataatgnccatggggctangtatgnaatttnagttngacnanacatannantntntacaagttctacggcggcccggctgtgctctacccgtnccggccacggcctcagctanaccaacttcagctatgcttccggcaccaccggcgcaactgtcaccatccacatcggcgcctgggagcactgcaagatgctcacctacaagatgggtgcgccgtcgccgtcgccagcctgcncgg

SEQ ID NO: 6277 - DNA, 299 bp, Zea mays
  misc_feature: Incyte ID No: 700351528H1
gggcaaacgaacaaaggcacagcgcacctcacttattacgaaccccctctgtgccactgcccactgccacctcaaatccccgcgaacctatctttcccttcccccgatccaggcggttctcttcccagaagccagcccagaatggtgggatccgacgcgctgcagtccatcgtttacagccgtgggtcactccgcctcctcgatcagaggaagctgccgctcgagatggagtacatcgacgtcaagagttccgccgatggctggaatgcaataagagacatggttgtccgtggtgctcc

SEQ ID NO: 6278 - DNA, 296 bp, Zea mays
  misc_feature: Incyte ID No: 700351529H1
gtttgttttcgtgcttgtgtgctggtagaatgcaggtagtttgtttgcataaacccaaagctaggtcatgtcctcgtttagtgaaccataacccaaatcgtcatcaatcctccaaaaattcctccaagtctccaagcatggatgagttcgagtttctcgttactactccatgaccgcttagataagctttttattggatgtaaaatgaacgcagacttaaaataaggatctcgagtacatgttctcgttgtttaatatgtgactctttgtagtcatttccctccaaaatcatgcct

SEQ ID NO: 6279 - DNA, 299 bp, Zea mays
  misc_feature: Incyte ID No: 700351530H1
  unsure 3: a, t, c, g, or other
ggngccgccgcgacaggaggaaggagcagcagcggcaggggaggcccggcgatctcttctgttgcgtgcggcgagggagtaaaaggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacattcggccg

SEQ ID NO: 6280 - DNA, 288 bp, Zea mays
  misc_feature: Incyte ID No: 700351533H1
aagaacaacccgcttgtgctccttctgtcgtcaacatctcctgcgtggtcactgtcactgaatccaaccaattccttgtgttccgtgaatccaaccatctcctgcgtggtcatcaacatctccttctgtcatccaccagatgtacgtgctgctgctccgtcgcggcgctggcttctccagcgctggcagcagggtcactggcccctccacagcactgggcgactcctccagcgctggggctagggttagaggtggtggatccggcgccgccttctccagcagggccag

SEQ ID NO: 6281 - DNA, 288 bp, Zea mays
  misc_feature: Incyte ID No: 700351536H1
  unsure 9, 19, 26, 50, 82, 109, 135, 175-176, 186, 197, 208, 217, 244: a, t, c, g, or other
ccggatcgnccgggtcgtnctgcaanatgaggacatcaccaccaagattnagggtgactggaagcggctcaacacactgatncattatcaggtgagagggggtgtcttntcccctcttcagcttcccagaatgtncccttcccgctaagccttgctctaaggcctcaaaagtctnnaaaggatttncctctccctgntttcctcctcntgctggagnatagaacagggattcttagccatggcngcccattggaattactgagggaatgataaaaaacgtgagtgacc

SEQ ID NO: 6282 - DNA, 288 bp, Zea mays
  misc_feature: Incyte ID No: 700351537H1
  unsure 63, 126: a, t, c, g, or other
atgagtggaaccaggaattggatgagatgactgagctagaggagaaggactaccaatccaggncctcctccctcaacatatccggcgaggaggcgtggaagaggagggcagcgatgagcggtaggnttctgctgctagaaccccatcgtccccacctcacggtgatggcttcgccattgggagctcatcttctgctgggttgggtgtgggtgccggcggacagatgactgctgcccagaggatgatggccaagatgggatggaaggaaggtcaggggcttggcaagca

SEQ ID NO: 6283 - DNA, 288 bp, Zea mays
  misc_feature: Incyte ID No: 700351538H1
ataggattggtggtgctcttgcatggagttctttgctttcttctagaagccgtgataggagcatcctccaccatgatatccgtgctcaagaagattatgttagcaagcttaccgggcacaaatctgaggactatggcgcatcacagtgtatgtctgcaattgctggctcctatggctatattgctccaggaatgcatatacccctaaggtcaatgagaagagcatgtctacacctttggtgtcgtgcttctgagctggtcaccggaaagaagccagtaggtgagtttt

SEQ ID NO: 6284 - DNA, 285 bp, Zea mays
  misc_feature: Incyte ID No: 700351540H1
  unsure 63-64, 66, 219, 231, 234, 242: a, t, c, g, or other
gggaagctccatttagatctggcggctattgctgctagtagttctgatgctccttcaataagnncncattctcagcatcacagatgaggtctggaatgaggaagttccagacctcatctgtgatgctgagaatgggctcttatggaagctccatttagatctggcggctattgctgctagtagttctgatgctccttcaattttggaattcctcagagncgaaagtctganccnagcatggnctatgatccaaggctagctatagttcggacatcatcctggaag

SEQ ID NO: 6285 - DNA, 290 bp, Zea mays
  misc_feature: Incyte ID No: 700351541H1
  unsure 52: a, t, c, g, or other
ttgcaccggcgagacttagagaggatcctccttacccttgggatccggctcngtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgct

SEQ ID NO: 6286 - DNA, 289 bp, Zea mays
  misc_feature: Incyte ID No: 700351542H1
  unsure 28, 62: a, t, c, g, or other
ccgacctccagacgaaaccacccaagangcgtgcttccattcctagcccaacagaagcgaanacgaccaccgaccaccggcctcgaagggatcatcttctctacaactcgtcctcgtggccttgttcctcctcttgtataggggactgcggcggagtggagatccgtgccgacatagtccgacttcttcgctcgctgcctacgattgatggcctcaccttcaccaaccgaagagttcagcagggaagcagtcgtcagtctctgatcgcgatctccgagtccattccgga

SEQ ID NO: 6287 - DNA, 233 bp, Zea mays
  misc_feature: Incyte ID No: 700351543H1
ggcagacgcagatcggcggcgggataggctagcaatgatccccaattccgacttcctctagactgcctggcggtcgaattccgattcgattggagtagggaacgagaagggaacaaatacaccggcaccaccaccagaccagacagcacgtgcctccatactatggtttacgccccgtgccgctcatcgacgccgccgtcttcctcgccgatgctccacaagaacctccgcgc

SEQ ID NO: 6288 - DNA, 289 bp, Zea mays
  misc_feature: Incyte ID No: 700351544H1
  unsure 228: a, t, c, g, or other
gtaaagggctaagattgcagttattagtttataatgtattgaaccttcaactttccagacaacaaaggttggatactttaagacacagattgcaaatctcttttgatggctcccgtattgaacatcaagtgtgtattactgatgtagattggttttctaggttgacatcatctcatgaagtaaattaattaataatttatgggcttatcattattaggatgccttgangcaactctggcgtttagcttatcccgctcgtgagattccaccactcaaatctgaattatgg

SEQ ID NO: 6289 - DNA, 290 bp, Zea mays
  misc_feature: Incyte ID No: 700351545H1
gggcaccatctcacaaaaacctgacctacgagctggtgcagaaaggtccggcgacggatgtgtccggacgtcccgtatccacagcgacgaacgcgtcgaacccgtggtggctgacgttcgagaaggccatcgcctccgcgggtggggagctgtctaagcctgagatcctgtcttcgaccacggactcacgctttgcgaggcagctgggcatccctgccctcgggttttctccgatgaccaggacgccgatactgctacatgaccataacgagtttctggaagacagagtg

SEQ ID NO: 6290 - DNA, 290 bp, Zea mays
  misc_feature: Incyte ID No: 700351546H1
  unsure 83: a, t, c, g, or other
gcctctctcttgctggttgccgctcgatgacattgttaagactctcatgcccaaatctgcaacatgtcaatcttgatggctgngatcaccttcaaagtgcagcattctgtccagtgggtctcgaatccctaaatctgggaatttgtccaaaactgagtgttcttcacattgaggctccaaatatgtctatattggagctgaagggttgtggtgtgctttccaaggcttccatcaattgccctcgcttgacttcgttggatgcctctttctgcaggcagcttgtggatgat

SEQ ID NO: 6291 - DNA, 294 bp, Zea mays
  misc_feature: Incyte ID No: 700351548H1
agcatgtctggttattctgctccccaagtctgtgcatccacctctgttttcacatatccagattcattgttctacaactttgaagaagaccggtcatataataagtttgaacgaggacagatatgggctctttacagtgattttgatggccttcccaaatactatggttgggttacaaaagttgattcagatccatttggagtgcacctgacttggctggaagcttgccctcgatcagagcatgagaacacatggttagagcatgacttacccgtgagctgtgggacatttaaa

SEQ ID NO: 6292 - DNA, 109 bp, Zea mays
  misc_feature: Incyte ID No: 700351549H1
  unsure 53, 107-108: a, t, c, g, or other
gccatgaaggccgagttcaacatcacgcttatccaccccaaggacctgacagncctgtccaacatgcttcccaaaggtcccagcaccccactttccagaagaccccnnc

SEQ ID NO: 6293 - DNA, 294 bp, Zea mays
  misc_feature: Incyte ID No: 700351551H1
  unsure 27, 150, 234, 264-265, 278, 281: a, t, c, g, or other
agcaagctcaaaccctaaccgccggcnacgccagcacgatggcccgctacgaccgcgcgatcaccgtcttctcccccgacggccaccttcttccaggtcgagtacgccctggaggccgtccgcaagggcaacgccgccgtcgggtccgcngcacggacaccgtcgtcctcggtgtggagaagaagtcaacccccaagctccaggactccaggtccgtgcgcaagatcgcgtgcntggacaaccacatcgcctggcatgcggggnntgaaggcggacgncgngtgctcatcaacg

SEQ ID NO: 6294 - DNA, 294 bp, Zea mays
  misc_feature: Incyte ID No: 700351552H1
  unsure 3, 76, 104: a, t, c, g, or other
ggnagaaatggagaacggcggcggcaaaggcgacgttcccaacgatgcgaacgaacattgccctggaacgcagtcngaggaggcggggaaggcggatgcctgcnctgggtgccccaaccagcagatttgcgccaccgcccccaagggccccgatcccgatgtggttgctattgttgagaggttggctactgtgaaacacaaattattagttttgtctggaaagggaggtgttggaaagagcacattctcagcccaatctcctttgccttagctgaaatggaccatcagttggcc

SEQ ID NO: 6295 - DNA, 170 bp, Zea mays
  misc_feature: Incyte ID No: 700351554H1
caccaagtcaccatcaccacccgcaccacacacgagcacacgcgacgactgacaaggcgaggggagcaatcggcggcgatgggcggcggcggcgcacatggcggcaccacctacaagggctacaccatcccgcacaacaagcgctggcacaccgtcgccggcaagggcct

SEQ ID NO: 6296 - DNA, 286 bp, Zea mays
  misc_feature: Incyte ID No: 700351555H1
ctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcatctgcaaatatgggacatgctggc

SEQ ID NO: 6297 - DNA, 286 bp, Zea mays
  misc_feature: Incyte ID No: 700351557H1
  unsure 140, 144, 146, 161, 233, 265: a, t, c, g, or other
caggagtaccggggacgacgatgtagcgataaagatcctgtactgtgggatgtgtcactcctgaccttcacagcatcaagaacgagtggcacaacgccacgtaccccatggtccctggtcacgagatcgccggagtggtnaccnangtgggcaagaacgtnaccagcttcaaggccggggaccgcgtcggcgtgggctgcatggtgaactcgtgccagtcgtgcggcagtgcnacgaggacttcgagaacagctgccgggccgtnatttcacctacaatccgtcga

SEQ ID NO: 6298 - DNA, 298 bp, Zea mays
  misc_feature: Incyte ID No: 700351565H1
  unsure 137: a, t, c, g, or other
agcattcagcgacgcatttgcctatatcagcactgtggtcataactctagtagagaaaggagaagatgcaggcatctagggcaaggcttttcaaggagtacaaggaggtacaacgagagaagtcagctgaccctgancatccaattaatatgtgatgattccaacatattcaagtggactgctcttatcaagggcccttctgaaacaccttatgaaggtggtgtgtttcaacttgcgttcgcattccagagcagtatcctctactgcctcctcaagttcgttttaaccaaaattttcc

SEQ ID NO: 6299 - DNA, 291 bp, Zea mays
  misc_feature: Incyte ID No: 700351566H1
  unsure 34, 182: a, t, c, g, or other
ctccatatggaagacagcaatcagcctcattgtnggaaggagctccaaggacaaacatcgacagcctctatggacaaggatcgtcaggcactggttttggtgcaggtcttcctcctggacgtgattatgcctcagtgaaaggcctgccccatccatcttcagaccctgatcaccgagatagntcttaccccgtgtacatccagccgtctcaatggttgatgatcgtagagttgatcgaattggttatcgtcgtgaatggatctaagagatgaggaacgcagagggactaat

SEQ ID NO: 6300 - DNA, 288 bp, Zea mays
  misc_feature: Incyte ID No: 700351567H1
tcatcactcctttggaggcgggcggcttggcttggagctcagctgctgtaactctgtcggcgggtacggtgcgcgcaggatcggggcaaggacctgggcggcttcatcgaggaaggcttcgggcctcaggggctcggcatcgtctccatcgccggcgtacccggttacccagagctcaggaaaaggctgctgcgcttggcgccaaggatcgtcagccttcctgatgatgtgaagaaacaactggaggacccagatagcagataccactttggttggagtcgtgtagaa

SEQ ID NO: 6301 - DNA, 178 bp, Zea mays
  misc_feature: Incyte ID No: 700351568H1
  unsure 146, 171: a, t, c, g, or other
ctgagccgcaaggaaaacgcagacagtgacagacgcagccccagatttcttttccatcaaaacaccccccgttcccctgctcccattccgccccggatttcgatttcgtcctcccttcgccgcccgcgccaagactttcctctgcnggggctgcaccggcagcgcggggtngaaaaca

SEQ ID NO: 6302 - DNA, 283 bp, Zea mays
  misc_feature: Incyte ID No: 700351571H1
  unsure 196: a, t, c, g, or other
taaggttggagggcacatcctggacaggattattttgcacaattttgcatgggagctactgcagaaggttgtcaacatttatgaaaaatttctttcatgtgttgaatctgggaattctacggtttcagagaaaggaattctgcaaatactgctagacttgcgtttcgttggtgatgtcctatcaggaggtaaaagntcttccaccaacagtcctgaaatgcagacaaaacaggattttttgccaagcgccgtcaccaagactccttcaggagaaaacagtcac

SEQ ID NO: 6303 - DNA, 283 bp, Zea mays
  misc_feature: Incyte ID No: 700351572H1
  unsure 11: a, t, c, g, or other
gtgacgcggantgcctttgcccctccgccgctgcctagatgtttcatttcatctttcggcgtgtgaggcacacgacacgataaggatggatgttgggtggggctgctccctctttcaatggaatgacagtcaatatcacgttggggagggactttagtgtactcctgaaagacttcagagtattgttgcagtaaggcttgaatagccagacgaagagtgtggtgcctacagagacaagctgttgagatgcagaatgaaactagaaatgcctttgttgagaagc

SEQ ID NO: 6304 - DNA, 283 bp, Zea mays
  misc_feature: Incyte ID No: 700351573H1
ccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtcttcaccaatcaccgcctccagatctgccaggaggaggacgactggaacgcatcgaggaccgat

SEQ ID NO: 6305 - DNA, 174 bp, Zea mays
  misc_feature: Incyte ID No: 700351574H1
  unsure 2, 36, 85: a, t, c, g, or other
gngccgctcacggagcagcagaaggccgcgatcgcngcgctctcccacgccgtggctcagggccattcccgcccaacctggaatnaagttcagggaaggatgaaggcttggctgttcccgagaaagaatctgctttggaggaggccggtgcatagatgcagtcttggtgaatac

SEQ ID NO: 6306 - DNA, 280 bp, Zea mays
  misc_feature: Incyte ID No: 700351575H1
  unsure 208, 222, 259, 262, 265, 275: a, t, c, g, or other
tatccgggaggtggtggctgtataatactgctttccaaatcattatgcgggtctcataatggatctgatctgaagaatgctttgcttcatgagatgattcatgcctatatttgcatcaaagacaataacagtaaccatagtgatcatggtgcaaaatttcagaaactgatgaatacaatcaatttgagttctgtagctgatccccatngaccagttgatggntacagcataactctgctccatgggatccatagaaatnttntcntacaaatgcnaagcg

SEQ ID NO: 6307 - DNA, 280 bp, Zea mays
  misc_feature: Incyte ID No: 700351576H1
  unsure 91, 100, 106, 197, 251, 271, 275, 279: a, t, c, g, or other
caaatctcaaatcacccggagagaactcgctcgcgaaggctgaactcatggctcgcgtcttcgttgggaacctggatccgcgtgtacacgnccgcggganattgangacgagttccgcacgtttggggttctgaagagtgtatgggttgctaggaaaccaccagggtttgccttcattgacttcgatgaccgcaggntgcacaagatgccattcgcgatttggaggtaagaatggttggagggtaagtgtnaaccaaagatggtggtggcntgcnaaana

SEQ ID NO: 6308 - DNA, 189 bp, Zea mays
  misc_feature: Incyte ID No: 700351578H1
ggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgt

SEQ ID NO: 6309 - DNA, 81 bp, Zea mays
  misc_feature: Incyte ID No: 700351579H1
gtacatctgttggcttgtattgtaccgctgctattgacccaactagtattttactttatgagaaagtgatgtgcacgaact

SEQ ID NO: 6310 - DNA, 292 bp, Zea mays
  misc_feature: Incyte ID No: 700351580H1
  unsure 246: a, t, c, g, or other
gcacccccactggtaatgccgtcgaagatgaagctggatgttgagggggtgcctggtcgggcgcccccactggtaatgccgtcgaagatgaagctggatgttgaggaccaggagctggctgacggcgcggtggtagaggaggtggtgcaccctgtggtgcgcggcttcgtcaaggactgggacgccatggaggacctactcaactacgtcctatacagggatattgggtgggatattggggacganggccagattctcttcaccgaaccctcttcacgccaaagactcttcg

SEQ ID NO: 6311 - DNA, 287 bp, Zea mays
  misc_feature: Incyte ID No: 700351581H1
  unsure 254: a, t, c, g, or other
attacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacttctgtgggacgcatgattacccgcanaatggtcaggcctggagtacttggtcttgcccg

SEQ ID NO: 6312 - DNA, 283 bp, Zea mays
  misc_feature: Incyte ID No: 700351582H1
  unsure 152, 195, 222, 261, 273: a, t, c, g, or other
ggctgtcttaatagaaattaaaatccttaactgtatgtgacatatgtggaggagaataaaagccaaagtcatcagaaatgcagtctgggtcacatccagaaccgctgtgttgggctggcaccagaatgcattgatgctttactattgtgacntctcaaggatgctgtagcattttctaagaacatggttgtaatnttcctaaaccagacctcctcataagangagaatgatgacattttgtctcctgtggacatcccattngtcagagtaccnggttttagaa

SEQ ID NO: 6313 - DNA, 172 bp, Zea mays
  misc_feature: Incyte ID No: 700351584H1
  unsure 44, 57: a, t, c, g, or other
ctttctgctgagctcaggaaatcccctctggtctccccgtcccncattccacccgcngccgccgacgcgccgcgcctgttcaagatgaatgtggagaagctcaagaagatggcgggtgctgtgcgcactggaggaaagggcagcatgcgcaggaagaagaaggcagtccaca

SEQ ID NO: 6314 - DNA, 158 bp, Zea mays
  misc_feature: Incyte ID No: 700351585H1
  unsure 35, 123: a, t, c, g, or other
gatgctattaaatgctaacaaccaaattatctgcngataaattggttgttagcatttaatagcatcaggtctcaacttaaaaggtaacaaccaatttatcagcagataatttgacttctgttncactattttctgagcacataattgactgcctctgc

SEQ ID NO: 6315 - DNA, 276 bp, Zea mays
  misc_feature: Incyte ID No: 700351586H1
  unsure 266, 275: a, t, c, g, or other
gccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaagctgttgaaggcaaatcgaaggatgaggcgatgaatgactacatcaccaagtgaaccactccaggaggaggctgccgcctntaaaatttnt

SEQ ID NO: 6316 - DNA, 277 bp, Zea mays
  misc_feature: Incyte ID No: 700351590H1
  unsure 271, 275: a, t, c, g, or other
cacgaaccaaaccaccgcctcctcccccgaccggagaggagcctcaccgccggcgcccatggcgacacgctacttgatcgtgtcgctgcccgtgcagtcgcccggcgccaccgccagctccctgtggtcgcgcctccaggactccatctcccgccactccttcgacaccccgctctaccgcttcaacgtcccggatctccgcgtcggcaccctcgactcgctcctcgggctcagtgacgacttcgtcaagtccatgtttcgtggaggggtntcanaa

SEQ ID NO: 6317 - DNA, 278 bp, Zea mays
  misc_feature: Incyte ID No: 700351591H1
  unsure 84, 151, 234: a, t, c, g, or other
ggccaaacgatacaggaatacgatacgccgctcgcctgaatcgagaccaccaccgctcccgctctgcctcacctcgccgactanagtttttgccgccgcggatctcgccgtccccgccatggatacgtcgggctcctccgcagccgccggngacgccccgaccaccggggagcaccggatggggaccaccattgtcggggtctgctacgagggtggcgtcgtcctcggcgctgnttccagaaccagcatggaatgtatgtagcaaacgtgcttcagaa

SEQ ID NO: 6318 - DNA, 276 bp, Zea mays
  misc_feature: Incyte ID No: 700351592H1
  unsure 31, 141, 270, 272: a, t, c, g, or other
ttggaaataaagacaaaactgaagccacatncatcatccctgatgtgaagaatttatcaacctcccgtgcttgcaaccttaacattatatttattagccgtgggcaagtaggacaaattattggtgaagatagctgttccncgaatgatgtggaaggatcttccctccaaaagcttgaagggaaatgttcctggggtaaaatgccgactaatttacttgcgccctctttggagaaatgtgtgatttaagtacaggagatgctgtggattngnctcc

SEQ ID NO: 6319 - DNA, 182 bp, Zea mays
  misc_feature: Incyte ID No: 700351594H1
  unsure 145: a, t, c, g, or other
tggactggggaaaattgcaaagctcataaatgctgggaaaattgattcctctgaattgattaccatgaagacactaaaggaaacaggtgccattgggaagcaaataaaagatggaattcgtttaatgggccgtggagcagaaganatcaaatggcctattcaccttgaggtgtcaagggcaa

SEQ ID NO: 6320 - DNA, 285 bp, Zea mays
  misc_feature: Incyte ID No: 700351596H1
  unsure 122, 219, 221, 225, 229, 233, 236, 262: a, t, c, g, or other
cgagtctccagagtcactccgttctaaggttgatgaagctgtagctgtactacaagcccaccaagctaaagaggctgcccagaaagcagttaacagtgccaccggtgttccaactgtttaanattgatcagggaccatgaaaagaaacttgtgcttcaccgaagaaaaatatctaaacatcgaaaaacttaaatattatggaaaaaaaacattgcaaantntganttcntagnaanaggaaaggaaactttgaccttatgtncgagcaatgccggtctgcaacat

SEQ ID NO: 6321 - DNA, 308 bp, Zea mays
  misc_feature: Incyte ID No: 700351601H1
  unsure 3, 235: a, t, c, g, or other
ganaatacatggggacaaaagaaaaggagatggaggtgatggtgcgtgggggaacaggtctgatgatggccatggcaattgggagcatcccagcaattggaatgggcagagtttggatgtagatcaggacacatggggaaacgccaggggaaaaaagaaggcagatggtaactactgtcaatgggaggagcagccaagcaattacaaacagaagaagacaaatgctgatcatgantcctcctataacaatgtgatgccgtcatcagaaattgcttggaatgctggagaggggactggaagaccaatgc

SEQ ID NO: 6322 - DNA, 301 bp, Zea mays
  misc_feature: Incyte ID No: 700351603H1
  unsure 23: a, t, c, g, or other
ccgcctgcaccctctcacgagcncccgctcgccccagatctagggttccatccgcgggcaagatgagcagcccccatggcggcctcgacgaccagatcgagcggctcatgcagtgcaagccgctcgctgagcccgaggtaagggctctgtgtgagaaggcaaaggagattctgatggaggaaagcaatgttcagcctgtaaagagtcctgttactatatgcggtgatattcatggacaatttcatgatcttgctgaactcttccgaattggtggaaagtgtccagatacgaatacctgttt

SEQ ID NO: 6323 - DNA, 300 bp, Zea mays
  misc_feature: Incyte ID No: 700351604H1
  unsure 92, 254, 257, 294: a, t, c, g, or other
gctgtcaagctatttgtcctatatttctcatttttacagaatctgtagttcctttgtgatgcaccatggttcttaaagcgttaaggcgaggncgcggcgttccaccaccttccggacgcctaggcgacgacaatacgaggcaagccgatgccttattatcatataaaggaataaaatggcagcaggatggagggagcacaagaaaaaagagagggagggagaagggagaaaaagagaagaggaaggggaagganaanaaggcctgccagcccaccagctcagcccatatggccntccatt

SEQ ID NO: 6324 - DNA, 297 bp, Zea mays
  misc_feature: Incyte ID No: 700351605H1
  unsure 41, 53-54, 85, 228: a, t, c, g, or other
aagaatgaagacaggagtatggatccttttggctgggattnccactttcggtnntttggatggcagaacaagagtgaggcaaagnttattgggtgaagaggttttcaaaaagtgaatcttgtaaccatggttagaaacttctgaagctggtagtcttgccaggtgcaacaatttcttttttgtattttgttttttcgagacaagatttctttgtatgaccttggccancctggagctagctctgtggaccatgctatcctcaaactcagagagaccagcctgcctctgcctcccaag

SEQ ID NO: 6325 - DNA, 296 bp, Zea mays
  misc_feature: Incyte ID No: 700351606H1
cactatagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagttgagacggcggacgacgagaacaagtggtg

SEQ ID NO: 6326 - DNA, 297 bp, Zea mays
  misc_feature: Incyte ID No: 700351607H1
  unsure 70, 208-225: a, t, c, g, or other
gcagcccccaccaccacttgttcaatctctctcctctcccgtctcgcctcccggagcgcaagaaaagctncggattcctggtggtttctaccatcctccgtcctcgatctgagcgttgcctgcttccctgcccccccgctcagatgtccgccttccgtgtcctgtaaaatctttcgccgcgcagaatctccccccacttgtcggctgnnnnnnnnnnnnnnnnnncaatggcgaccaagggagggaacgcaaggggcgttccggtgggggcgctgctggtggccgcgtcctccttag

SEQ ID NO: 6327 - DNA, 297 bp, Zea mays
  misc_feature: Incyte ID No: 700351608H1
caagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaat

SEQ ID NO: 6328 - DNA, 297 bp, Zea mays
  misc_feature: Incyte ID No: 700351610H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaa

SEQ ID NO: 6329 - DNA, 294 bp, Zea mays
  misc_feature: Incyte ID No: 700351611H1
  unsure 114: a, t, c, g, or other
cccgttgagcactagcagcctccttgaaacctccagatctgtgcctccaaggcccccgttcctcggcaacaagccgtccagatggacaccgccgcgcccctgcaactgaaagcntgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggag

SEQ ID NO: 6330 - DNA, 293 bp, Zea mays
  misc_feature: Incyte ID No: 700351612H1
aagacagaggccagtcacaaggcgatagcagcaggtggtggcaagatgacggtgctccactctccggttggagttaggagcatcgtgacctccttggtggctttcttcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaatggtccaggggaagg

SEQ ID NO: 6331 - DNA, 303 bp, Zea mays
  misc_feature: Incyte ID No: 700351614H1
  unsure 38, 84, 86, 88, 113-114, 120, 155, 193, 299: a, t, c, g, or other
aggctaactatatcctgggagacaacccgatgaagctncagctaccttgtgggatatgggagcagctacccaaagcaagtgcancnanagaggggcgtcgatccccgcggatnncgaacnacaggctgcaaagggttcgagtatctccactcgcncagcccgaacccaaacgtgagctacgggcgccctggtnggtgggccattccagaacgacaccttcgtggactcccgtgacaacgccgtgcagacggagtccagcacctacaacagtggcaccctggtcgggctcctctccggcntcgt

SEQ ID NO: 6332 - DNA, 299 bp, Zea mays
  misc_feature: Incyte ID No: 700351615H1
ctgctgctctagcaatcatgacccttcatggccgtcacatatatggacaagcaatcaaggtgaactgggcatacgcaagtacacagagggaggatacgtcggggcatttccatatttttgttggtgatttaagttctgaagtgaatgatgcaactctttatgcctgtttctcagcatatccttcttgttctgatgctcgagtcatgtgggacaacaaaactggacgttccaggggttatggttttgtctccttccgtaatcaacaggaagctgaaactgctataactgaaatgactgga

SEQ ID NO: 6333 - DNA, 297 bp, Zea mays
  misc_feature: Incyte ID No: 700351618H1
  unsure 134, 182, 268: a, t, c, g, or other
gcacaatggagatggactctggatccctgcatctgaaagaaaaaggcaagaaaatgcagggcagggaaaatcctgaaggtcttcactgaccatgaattaaaatcctaattgacagttttacaaacaaaaacccncgttttagtacttgtgttgtttttgtttctgttttaacaagcttaganttattattgtgccttttatggaagatgaggaagaaataggaaagcagtaaaatgaacaatgagaatctgttacccaaactgatatnaactccctcagaaagaaagatactactcc

SEQ ID NO: 6334 - DNA, 242 bp, Zea mays
  misc_feature: Incyte ID No: 700351619H1
  unsure 9, 15, 106-122: a, t, c, g, or other
aggagtttngttctnattcaacaaaacaatctcacgctcggaacatttgcacagctagttttgttgaatcataaccatctgcgtgtcccgatttactacgggggannnnnnnnnnnnnnnnnaggagtttggttcttgcttttggtgtcctgatgtaatgtaacgagggccgcgccatgggctcattcaaatgtttttttttgttttaatagtccgaggaatgaaatgatggcttgtacagc

SEQ ID NO: 6335 - DNA, 291 bp, Zea mays
  misc_feature: Incyte ID No: 700351622H1
  unsure 17: a, t, c, g, or other
aggcggacgccgccggngagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgt

SEQ ID NO: 6336 - DNA, 287 bp, Zea mays
  misc_feature: Incyte ID No: 700351623H1
  unsure 3, 13, 21-22, 25, 28, 35, 51, 68: a, t, c, g, or other
canaccagctgcnctcactcnncanacnacacctnctactccaacaagganatcttcctccgcgagcntatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagc

SEQ ID NO: 6337 - DNA, 290 bp, Zea mays
  misc_feature: Incyte ID No: 700351625H1
  unsure 9: a, t, c, g, or other
aaccgagtngccccggcgacgcgaggccgaggcgagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctga

SEQ ID NO: 6338 - DNA, 291 bp, Zea mays
  misc_feature: Incyte ID No: 700351626H1
  unsure 98: a, t, c, g, or other
ccttgagcagagggaggctgggtctaccatggatgttgttgctgcacaaacaaaagcaattgctgagaagatcaaggactggagcaacgtagttgttngcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcg

SEQ ID NO: 6339 - DNA, 292 bp, Zea mays
  misc_feature: Incyte ID No: 700351627H1
  unsure 25, 32, 35, 60, 114, 281: a, t, c, g, or other
catcgttctcaagatcaatggggangacaccngcntcattagcccaacccttggattcancatcaagaccatcaagtaccacaaatactctttgaacatatgggatgttggagntccagaagacaatcaggtcttactggagaaactactttgagcagactgatggattagtttgggttgttgatagttcagacataaggaggcttgatgattgccgtgctgaactccacaatctcttgaaagaagagagactagttggagcttaattgttggtttttgcnaataagcaaga

SEQ ID NO: 6340 - DNA, 290 bp, Zea mays
  misc_feature: Incyte ID No: 700351628H1
gcaaagcaccgccttgcggcctgtcgtacaatgttgcagaagtattctcttggtgaccgtactcggctctttgttgctgatggaactttgttttcccttttacctgtgaactccaggatgcaaagaatggaagggtcaattggcgttgaagaaaatggaagcatattcccagaatggacttcaaggagatcatggaaggatcggcagaagactaggaaagcaaatgcaaatggtcaacagcacctactggcagcttcagaacctgaactgatatactatggtaaacattc

SEQ ID NO: 6341 - DNA, 292 bp, Zea mays
  misc_feature: Incyte ID No: 700351629H1
aaatcgcctcagttcttccgtccaaggatctcggtccgaaccctgaccaggcagtcaggcacccaccccaatgctatgtccaaacttcagtcagattcgtcaggcaaacccaccacaccttgggtctgtttggttcagcttttttctgaccagcttttctgaaaatctggctgtgggaagaatctggttgtgaggagaatctgagtatcattacgattacgcgtggaggaggataaagttgttcgtagggctcaggatctagaaagtgacggtttcctactattacaacgac

SEQ ID NO: 6342 - DNA, 292 bp, Zea mays
  misc_feature: Incyte ID No: 700351631H1
  unsure 42: a, t, c, g, or other
gcctgataggcagtcttatgctgaaattgtgcaacgcagagnactgctccaaagtgcgtttacggctgcttttgactttgttggacgaattctcagaaggtgttcagagctccatgatattgcatcaagcttctatctgccagccattttggtctatattgaatggctggcgtcccatccagagttggctgttgattcagagatggaggaaaagcatgcaaatgccaggtctttcttctggagccaatgcatctcatttatgaataagttgatcctaccaaccttgcatctg

SEQ ID NO: 6343 - DNA, 299 bp, Zea mays
  misc_feature: Incyte ID No: 700351632H1
  unsure 14, 115-116, 168, 201: a, t, c, g, or other
cttctctacctgcngcacccgcacagccacagccaacccacaccccccacatcacaacagctccctctgcatctccgcctcgtcgccgtcgtctgcctgcacaaccttcttcttnntctctctctcttcttccgctgccaccctcccagcaccgagggaaggcaagcncacccaggaatctccgtcccgctcccggccgcngtcccttctcataatcgcatcggatctgtattgggttttcagtaaggagcagaaaacgcttagggaatgcagaaagatgtgttgacgtcgaagagtat

SEQ ID NO: 6344 - DNA, 289 bp, Zea mays
  misc_feature: Incyte ID No: 700351634H1
ggctcacagaccaacaatacacaaaccaatttccttttgaagcttgcctggtcatgaagcaccaccttgcggagaccatccacaaggcttggggctcacctgaatggcttcaacctacatataacctggaaacccatttgtctccactcattggtgattattgtgtgaggaaacgagatggcatggacaatttatggatcatgaagccttggaacatggcgagaacaatcgataccacagttactggtgatttgtctgctatcatcagacttatggagacaggccccaa

SEQ ID NO: 6345 - DNA, 288 bp, Zea mays
  misc_feature: Incyte ID No: 700351636H1
  unsure 52, 56: a, t, c, g, or other
ccagaatcgcctgacacctgaagaaatcgaaaggatggttaatgatgctganaagnttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaaga

SEQ ID NO: 6346 - DNA, 282 bp, Zea mays
  misc_feature: Incyte ID No: 700351639H1
  unsure 38: a, t, c, g, or other
ctgcccgtcgtcgtatcccccggtccgccggtcacctngacaaacggcgaagggcggcaaaatgctgcagtgcatctttctcctctccgattccggggaggtgatggtggagaagcagatggcggcgcactgcgtggaccgcgctatctgcgcctggttctgggactacgtcgtcgcccacgccgccgggatccttccaaagtcttacaggttgtggtgtcaccaacgcattacttgtttcaaatctatcgcaatggtgtaacgttcttggcatgcacccaa

SEQ ID NO: 6347 - DNA, 282 bp, Zea mays
  misc_feature: Incyte ID No: 700351641H1
aatgaaactcaaaatccagtagaggttgtgaggccttgtggtgcatgcaatggatctgaaatgttgcttaagcgaagggcgagtggtgaatttatggttgggtgccgaagttatccacaatgtagaaacgtggtatggctcccaggatctctttcagaagcggctgtaactaatcaagtttgtcctatctgcgcaccaggccctgtttataagattcaattcaagttccgtcggagggatattccaccaaatttcgatgttgatcacctaggttgtgttggt

SEQ ID NO: 6348 - DNA, 285 bp, Zea mays
  misc_feature: Incyte ID No: 700351643H1
  unsure 32, 36-37, 39, 48, 58, 67-69: a, t, c, g, or other
gttgatataccggatgctactgatgtattggnagtnntnattgcacgngctattgtcnatgaaattnnncctcctgttttcctgcactcgagctagggcactacttccagaattttccaagggcattcaagttctgcaggttgttgaaaagaactatttgtcagctccccaccatgcagaattagttgaacgcaaatggggtggaagcacacactctactgtagaagaagcaaaaagtaagattaagaatattctaagagaatatattgagaatgaagacataga

SEQ ID NO: 6349 - DNA, 283 bp, Zea mays
  misc_feature: Incyte ID No: 700351644H1
  unsure 2, 240: a, t, c, g, or other
gnaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttnttatttcttgtattttttgttgagctgttttaacacatattgg

SEQ ID NO: 6350 - DNA, 283 bp, Zea mays
  misc_feature: Incyte ID No: 700351645H1
  unsure 9, 98, 136, 183, 203, 226, 230, 245: a, t, c, g, or other
ctcctcganaactgtagcatcacgcgccgcctttgattgagcagggactgggagagaggagaagagatggtgaaagggggcaagaaaacgcttcttgntgcctttgtgcttcagcggatccgcggtggctgcgcangccggcggggaagaggagtcgcgggcggcgcgcctccagtctttctncgcctccgtgctctccgggntcttcggccaggccgaggccgangacnaggacgaggacgaanagatgcccacggcaaccacaacgctgccgcggctgccg

SEQ ID NO: 6351 - DNA, 287 bp, Zea mays
  misc_feature: Incyte ID No: 700351647H1
gtgctgcttccaggtggccatggcctcatggttcgtgggtatcgtccggttataaatactctcgcaaaaggcttagatatacgcctcaaccataaggttgtggaaattgttcgccataggaacagggtagaggttaccgtaagcagcggccaaacgtttgttgcggatgctgctgtggtcactgttccgttgggtgtcctgaaagcgaaaaccattaaattcgagccgaggctgccagagtggaaagaggaagcgatcagagaacttacggttggagttgagaacaa

SEQ ID NO: 6352 - DNA, 291 bp, Zea mays
  misc_feature: Incyte ID No: 700351648H1
  unsure 277: a, t, c, g, or other
gaaaacctccaaggctccaaccctagccgcgatccgacaacgcctccatccctagccgactgctgcaagttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcancggagctgttcatc

SEQ ID NO: 6353 - DNA, 281 bp, Zea mays
  misc_feature: Incyte ID No: 700351649H1
aattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacatatttttttgtactgctggtcctg

SEQ ID NO: 6354 - DNA, 280 bp, Zea mays
  misc_feature: Incyte ID No: 700351650H1
  unsure 135, 257: a, t, c, g, or other
ccgcgaccgccccaacccaactgcccttttcggagatctcgccgcctccgccgtcgacttccgtcgcccccctatcccgcgtccgggcttacccgatggcacggctgcactggcttgaggccgtcctgccgctgnggatcatcggcggcatgctctgcatcatgggcaacgcccagtatttcatccacaaggccgcgcacggcaggccgaagcacatcgggaacgatatgtgggacgtcgcatggagcgccgcgacnaagaaagtcgtggaacaatcctc

SEQ ID NO: 6355 - DNA, 276 bp, Zea mays
  misc_feature: Incyte ID No: 700351652H1
  unsure 21, 56, 88, 116, 131, 163, 225: a, t, c, g, or other
cgccgatctgctcctcctgantcctgaccctcctccgtgcgctgcgcaggcatgangctcctcctcgtcggcgccctactcctatgtnccaccgcggcggtggagtccaagccgcncctcgacaccctggncatacccccgcaagatgaggcgtactacagangcggcgtgattaaatgcagggacggatcaggcaggttctcccgggagcagctcaacgacganttctgcgactgcaccgacggcaccgacgagcccgggacatctgcgtgcctg

SEQ ID NO: 6356 - DNA, 278 bp, Zea mays
  misc_feature: Incyte ID No: 700351655H1
  unsure 94, 126: a, t, c, g, or other
ctctgcttcacacagaccagtgcgcgctcaattcccccctctagcgcctccaccgcaccaaaccggtccaacgggacctatgctctagcctcanagcaaaccaccgcctgaattgtgcggcaattngaccgaggattcgcggcaggcagggcgcggatccgttggcgggatgattgcggctgtcaacagagtgccggcgggctggggcgaggatgagatgtccgtggctgccacgcacaccaaggtggtggtcaccggcaacaaaccgcaccaagtcg

SEQ ID NO: 6357 - DNA, 276 bp, Zea mays
  misc_feature: Incyte ID No: 700351658H1
  unsure 259: a, t, c, g, or other
caagaaggaaaaatcacttaacaacatctgcaaccaaattgagcaagtccagtctagcattgcaatgaagaatgatgaaatgggcacagagcttattgatcagctaacttcagaagaaagagatctcctttcacgattgaatcctgaaattactgatttgaaggagagatttctaatgtgtaaaaacagtcggattgagatcgaagcacgaaaggaagaattggagaccatttatcaacaaatcttatcaggcgtcagnaagagctagaagcgata

SEQ ID NO: 6358 - DNA, 275 bp, Zea mays
  misc_feature: Incyte ID No: 700351659H1
  unsure 60, 87, 146, 159, 165, 175, 230, 243, 258, 271: a, t, c, g, or other
cacgtagactcccccttccacctcgttcgcctccctggagacgagcgcctcgccgctcangtcgccaaccgcagcttgttggtgaanggggtctacgagctctggggctatggcactacctacgaggagctggagaagtcggtcanggagtaccccgangagagnaagttccgtncctggtcccggaaagcagcttcaagatcgttatcgacagcttcggcaaggtgatnagctcccaagagnagaacgagatcatanagagcctcatttncata

SEQ ID NO: 6359 - DNA, 277 bp, Zea mays
  misc_feature: Incyte ID No: 700351660H1
  unsure 2, 255, 274: a, t, c, g, or other
anaaaccgcgcatcccgctgcccccttactcatcctccccgctgctcgaaggagagccaaatccagagcgccgccgcgatggcctcccctgacgcggaacagccggcgccgacggaactcgagcggtggcgtgacctcgacatgctcttgtcccgccctggaaacctcgtggaggccactttcgatcccagccccggcctgcgagacctactggggagcctcgtggagttttggttgtgggcgcgggcgggcttngctgcgagtcctcaaggantgg

SEQ ID NO: 6360 - DNA, 282 bp, Zea mays
  misc_feature: Incyte ID No: 700351661H1
  unsure 55, 64, 68, 85, 241, 246, 250-251, 253-254: a, t, c, g, or other
ccccaacgacggcgtgctgcgggcggacgtggagctgcaggcgtggtggaaggangcgcgcgangtcnggcacgccgacctcaanagacgcgaacctggtggcccaagatgcagacggtggccgagctggtcaaggcctgcaccaccatcatctggatcgcgtcggcgctccacgcggccgtcaacttcgggcagtacccgtacgccgggtactcccgaaccgcccgtccgtcagccggangccgntgcnngnnccgggcagcgacgagtacgcggactgga

SEQ ID NO: 6361 - DNA, 281 bp, Zea mays
  misc_feature: Incyte ID No: 700351662H1
  unsure 85, 221, 227, 237, 242: a, t, c, g, or other
ccgacatcctactttcgtcctcacgagtgaccgataatccgccggcgctaagatgttggtttatcaagatctcctatctggcgangagctcctgtcggattcattcacctacaaggagctcgagaacggcgtcctgtgggaggtcgagggaaagtgggtcacccaaagtcctgttgatgtagacattggtgccaatccatccgccgagggtggttaggacnaaaacnttgattacanagccntgaaggtggttgatattgttgacacatccgtctacagga

SEQ ID NO: 6362 - DNA, 279 bp, Zea mays
  misc_feature: Incyte ID No: 700351665H1
  unsure 51, 77, 101, 146-147, 207, 231, 235, 259: a, t, c, g, or other
gcgatatcgggaagaggaaactcgaaagcccggcgagcggtatggcaaccngcgaggagcacgtggcggcgccggcnccggcggtcgaggagacgccgganaagaagcaggccagcaccaaccgagctccccgcaccctcaggctnnacgaagaagcttgccccaactcgaggtggacgaggtggacgatttgaggttatttttgtntccccaactggtgaggaaattaanagcnagagacagctgactcagtactganaagctcatcctggaggcctg

SEQ ID NO: 6363 - DNA, 272 bp, Zea mays
  misc_feature: Incyte ID No: 700351667H1
atatgccaacatgactgagcaacagaagcaaatccagcatcacctgatcgaaaaaacatttgacaactacttgcacgaggaatcagatattatattgaaaagacctggcattagggcaaggttgcataatctaatgattcagctgaggaagaattgcaaccatcctgatcttttggaatctccagttgattcaactggtttatatccacctgttgagaagctcctggaacagtgtggtaaattccaactttttgacaggttgctaaattcct

SEQ ID NO: 6364 - DNA, 270 bp, Zea mays
  misc_feature: Incyte ID No: 700351668H1
ctcattgctttgatctggcaatacgatttctctcccttcatggttcttatcattgccattctcaatgacggtactatcatgaccatctctaaggacagagttaagccatctccattgcccgacagttggaagctgaaggagatctttgctacgggcatcgtgcttggaagctaccttgctcttatgactgtcattttcttctgggctatgcacaagaccgacttcttctcggacaaattcggtgtgaggtcgatcagggacagcgagcat

SEQ ID NO: 6365 - DNA, 96 bp, Zea mays
  misc_feature: Incyte ID No: 700351670H1
  unsure 5-7, 14, 39, 44, 48-49, 60-61, 72: a, t, c, g, or other
ggcannngcacacncgccaacaagctaataaaggccggncatcncacnngcaaagggcgnnacaggagccanggcggaggagaagcaccaccacca

SEQ ID NO: 6366 - DNA, 272 bp, Zea mays
  misc_feature: Incyte ID No: 700351673H1
  unsure 45, 56, 132, 142, 154, 223, 227, 233, 242, 249, 252: a, t, c, g, or other
ctaaaaccctaacccctagccagcgctccgccgccatccgccggngagatggcgtngtacctgctgttcgagtcggcctccggctacggcctattccatgcgtacggtatcgatgagatcgggcagagcgtngaggccgtgngctcctccgtgntggacctcgaccgctttcggcaaggccgtcaagctcactgccttcaatcctttctcctctgtcgttgangcgntcaaancagtgcaangtatctntgnaggaatcatgaccggatgag

SEQ ID NO: 6367 - DNA, 269 bp, Zea mays
  misc_feature: Incyte ID No: 700351674H1
cctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagtcatcttcacccgcgcaaagcagtacgccgaggaatacgatgcccaggagaaggaactggtgcagttaagcgtgaggcccg

SEQ ID NO: 6368 - DNA, 270 bp, Zea mays
  misc_feature: Incyte ID No: 700351675H1
ggtttctattcatttcatatggttgcctgaaatgtactacacttatttagttaaatatgttctattttttgtgcgagtaccttcattgtacagcatgggtaccgactggaaccaagttatgacacaatatggaagttacctatccgaggatgatgccactcagtttcagaacactgcatttgctccttcgcctgagataccagcccagggatcaccagcaccacctccagtgaagaaggtcctcaacgcacaaagctagcaaatttcacg

SEQ ID NO: 6369 - DNA, 277 bp, Zea mays
  misc_feature: Incyte ID No: 700351676H1
  unsure 154, 162, 165, 170, 179, 183, 188, 190, 223, 226, 245, 250, 260, 265-266,: a, t, c, g, or other
agctcgctctctacctgcaccagcctcgcccgcccttcgctcgccgccgccatggggaggggaaagttcaagggaaagcccaccggccgccgcaacttctccacaccggaggagatcgctgctggtacttcaggtcgccctcgcacctttaagnagaaggangangatgnagaggaggnagangaaangncagagtctgaggaggaagaatctgaagacgagnctnatgacaaacctaaacatanaggtnctgagggtantattnngnctgaanntc

SEQ ID NO: 6370 - DNA, 272 bp, Zea mays
  misc_feature: Incyte ID No: 700351677H1
  unsure 244, 267: a, t, c, g, or other
gttctgcatagtattctgtgcagttatttgattgattcacattttcaaatgatcggttgaaactctgttatgcttgactagactgaatctagattgtttactaaaattgggcatgggttttaattgtagtggtttgtagctatctgtcattgtacactgattcaagtgacaacgatttcttttctgtggatgcattttagtaggattggccaccaaggtcgtggagtatatggtgcccattttnatgaggtctggtgggatatcatnaccta

SEQ ID NO: 6371 - DNA, 284 bp, Zea mays
  misc_feature: Incyte ID No: 700351679H1
gcggaggtggatcagaaacttaagtatgctaatgatctttcgtcgggtgtgatattcggaagagagcttgtgaactctcctgcaaatgtccttaccccctgctgtgcttgcggaggaggcgtcaaagatcgcttctacttacagtgatgtgttcactgccacagtactagatgtagagaaatgcaaagaactaaagatgggttcctacttgggagttgctgcagcttctgctaaccctcctcacttcatccatttgtgctacaaacccactgatgggaacgtca

SEQ ID NO: 6372 - DNA, 210 bp, Zea mays
  misc_feature: Incyte ID No: 700351685H1
  unsure 47: a, t, c, g, or other
aaaaaaataaggaatccacaatgctggcattcatcagcaatgtcttnggaagataattttcacactcctctgtcatgcaggctcaggaatacattatcttttcatatatgatcgaatgctggaagctagggaagagacggataaatggatttacccttaggaaacaacaagttcatctcctcgaaattctataatatcatctttgcatcc

SEQ ID NO: 6373 - DNA, 265 bp, Zea mays
  misc_feature: Incyte ID No: 700351687H1
  unsure 35, 211: a, t, c, g, or other
cgtttccttacttcctggtaaagaaagaagcgaanccaggtacttgttgttgagcgcggagagaggagaggcgcagagcatcgacgatggcgagcggcagcatgaagagggagatcagcgagacccacgacaccctccgcttcggcctcaatgccggcgtcaaggccgaccttcgcgccgccgcacccgtcccagtccagcatccaattcngagggcaagttcttgggcggacaagaagaagttgggacagaggccatctacgga

SEQ ID NO: 6374 - DNA, 265 bp, Zea mays
  misc_feature: Incyte ID No: 700351689H1
  unsure 56, 106, 121, 241-242: a, t, c, g, or other
ctcttcgccgctgccgccaccgctccaccgggcagccagccagccatggatgaggngtacgacgtgatcgtgcttggcacggggctcaaggagtgcatcctcagtngtctcctttccgtcnccggcctcaaggttttgcatatggacagaaacgactactatggaggagattccacctcgctcaaccttaatcagctctggaagaggtttagaggggaagacaagcccccagcacatctanntgcaagcccgagactacaatgtg

SEQ ID NO: 6375 - DNA, 266 bp, Zea mays
  misc_feature: Incyte ID No: 700351690H1
  unsure 68, 104, 180, 184, 217, 245, 258: a, t, c, g, or other
attctatagaagaaattgggatcttccttctgtttttcctggaaaaactgcagtgcttgtgtcatatncatttcctgttacttccttgtttaatttagttctgnagttacttacatctttttttttgtacggcaatgctgtcatacctcctctcagttaagaccaatataggcatcatcntttncgagtaggtatgtcgttgtggttcaatgttcgnataactcctttttccatttcagtcatgnatttatgtccgcnaaacatgt

SEQ ID NO: 6376 - DNA, 265 bp, Zea mays
  misc_feature: Incyte ID No: 700351691H1
  unsure 232, 247, 252: a, t, c, g, or other
ccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgangtgatcatcactgantcctnagaccccatgggc

SEQ ID NO: 6377 - DNA, 268 bp, Zea mays
  misc_feature: Incyte ID No: 700351692H1
  unsure 3, 9, 39, 48, 90, 153, 195, 222, 226, 229, 232: a, t, c, g, or other
gangatgtngacggaaaggattatgcatgaatgcattanaaaattgtntggaaatcatgatgatcctgatgaggagaacattgaagcatnatgcaaattgatgagtacaattggtgatatgattgatcatgtaaaggcaaaggagcacatggntgcctattttagtatgatgcagataatgtcaacaaatcagangttgtcctctcgtgtaaggttgatgtncganatncantcgacctgaggaggaataaatggcagcaaaggcgtt

SEQ ID NO: 6378 - DNA, 270 bp, Zea mays
  misc_feature: Incyte ID No: 700351693H1
  unsure 54, 114, 156, 214, 256: a, t, c, g, or other
caggcaggcaggtcggcgaggagggcaggaagaccgaagaccgagccgtgcggnggctcgggacgggaacgggacaggacctcaaaatctcaagatccttcctgcccgcccgcncgtgcccgttcgacgcgtcgtttcttgcccggccgggcccanttccgactcttctccttcagggggatcggatacgccacaaggtgcgcgatggtgtgtnggtcttcggctacggctccctcatctggaaacccggtttganttcgacgacaaatc

SEQ ID NO: 6379 - DNA, 272 bp, Zea mays
  misc_feature: Incyte ID No: 700351694H1
  unsure 23, 34, 52-53, 67, 75, 83-85, 105, 113, 117, 159, 162, 179, 181, 193, 200,: a, t, c, g, or other
tgaaataagctgttttcaaaggnacagaaggganacttgctacctgttctgnncagcagtgtaaacntcacaggnctttggcnnnctcccagatgtagaggagantgaagganaggnatagttagggatgcacaggaatttatctgtctctgatcaggnaanaaagctggctatgggtntncaggggcatgantgatggntgtntgnctcttttcaccctgtaagtgaatccctgaactggnttcatgnggcaatctggttanctnttctat

SEQ ID NO: 6380 - DNA, 283 bp, Zea mays
  misc_feature: Incyte ID No: 700351696H1
  unsure 58, 81: a, t, c, g, or other
ccgatgctggcaccccacgtggcccgcgaggacacatccgtgggacggatacgacgtnctcgctggcacggtcttgttcanccaacgtgtgggcaatcggccgcgaccctggactgtgggacgcgccggaggagttccggccggagcggttcgtcgagagcaagatcgacgtgaggggccatgacttccagctgctgccgttcggtctggccggcgaatgtgccccgggatcaacctcgcgctaaaaggtgatggtttgagtcttgccaatctgctacacggc

SEQ ID NO: 6381 - DNA, 305 bp, Zea mays
  misc_feature: Incyte ID No: 700351702H1
  unsure 225, 228-229: a, t, c, g, or other
aactctgataatcgagacctctcctacctgcctcccttctctcctctactgcgccttcctacctacactaacatctagtatcagattagggttcgatccctgttccactccattgcctcatggtgccatctacttcttcctccttcgattcgaccctcaccctcgctctggagcaccaaacccgatccctgcttgctgaactggataagtggttccagtccaaantanngcaggtgggaaatgcgggtgtccgccctggagtccacggcggcggacgcgtccagatccgtctccgagttctcgtc

SEQ ID NO: 6382 - DNA, 180 bp, Zea mays
  misc_feature: Incyte ID No: 700351703H1
  unsure 11: a, t, c, g, or other
cactgctcgcngacccctactgctggaacgcgtacggggtcatggagacgctcacgctgcacaccggtgtactgcttgctggagggcagcccggagtctctccaggatccgctcaccagttgctgagatgagatcgttttctttactaacaaagatttctctcctgagacagtcaacgct

SEQ ID NO: 6383 - DNA, 302 bp, Zea mays
  misc_feature: Incyte ID No: 700351705H1
ggagccaataaagtccaatttgaaggttgttaatcgccacaaccatgacacaatttctatggctgtgattgacaagatgggccacatagcagttgggacatcaaccaatggcgctacatttaaaattccaggaagggtgggcgatggaccaataccaggatcttcttcatatggtgatgatgaagttggcgcttgtggagcaactggtgatggtgatattatgatgcgcttccttccatgctaccaagtggtagagagcatgcgacaagggatggatcctcgagacgctgccacagatgcta

SEQ ID NO: 6384 - DNA, 302 bp, Zea mays
  misc_feature: Incyte ID No: 700351706H1
  unsure 108, 190: a, t, c, g, or other
cgaaacgactccttcagttccgtcccgttcgtgacgatccccggtcccgggagggggagggggagggggagggagaggcgaggtcatggcctccggcaccggctccgnccagccgcaacccgcagcagctgatgctgacccgggagccggcgacaacaagctcgtcttcgagacgccgctgcagccgcancccgtgagggaggactacgtcgagaacgccgtcaagttcctctcccacccaaaggtcaggggctcccccgtcgtctacagacgatccttcctcgagaagaagggcctcacca

SEQ ID NO: 6385 - DNA, 299 bp, Zea mays
  misc_feature: Incyte ID No: 700351707H1
  unsure 35, 200: a, t, c, g, or other
ggctggaagtggaaagaagtgggttcttgcttganctgagctcttgctgcccttgaatctgttagggagtggagaacggagtatggggcgcggcaagatcgagatcaagaggatcgagaactctaccaaccggcaggtgaccttctccaagcgccgggccggactggtcaagaaggcacgggagatcggcgtgctctgcnacgccgaggttcggcgtcgtcatcttctccagcggcggcaagtctacgactactgctcgcccaggacctcgctgtccaggatcttggagaagtaccaga

SEQ ID NO: 6386 - DNA, 292 bp, Zea mays
  misc_feature: Incyte ID No: 700351708H1
  unsure 71-87, 99, 152, 179, 185: a, t, c, g, or other
cggacgccttacacccagtgccaaccgccgtgccctcaccctctctatatgcgccgtctctcactctctannnnnnnnnnnnnnnnnctacgccacgcnaaaagcgccacaagattcgcccctggctgaaaacgcactcgatggcgtccgcnactggggtttcctcctcggagatggcngtggancacgcgacggggccgggcgccgtggacaagccgcggttcgatgctctgacgccgaatgagatgagcggcgggaggccccagttccggaaagtgcccgtcccgcagca

SEQ ID NO: 6387 - DNA, 295 bp, Zea mays
  misc_feature: Incyte ID No: 700351710H1
aaatctcttacgacgaagccaaggcagaaagtccaatatctttatcatcaggactacgaaggagatcaactcatcatgagagaaaagaagatattggagcacctataaaattggatgcagaagctcaggctcacattgagaagcataggaagcttcaagaagatttgactgatgaaatggtcgagttagcacggcaactgaaggaaagtagcctaatgatgaaccaatccgtgcaggagacagagaagatccttgattctaccgagagggccgtcgagcacagcctggcaagcgg

SEQ ID NO: 6388 - DNA, 292 bp, Zea mays
  misc_feature: Incyte ID No: 700351712H1
cagtcttgttccatccaatccccatggtgttttccaaaggagaaggttcacacatagtggaccccgaaggcaacaaatacattgattttctctctgcttattctgcagtcaatcagggtcattgccatccaaaagtcctgagagctttgatagaacaggcagaaaggcttactctcagttctagagctttctacaatgataagttcccaatctttgcggaatatctgacaagcatgtttggatatgacatgatgttgccgatgaatactggtgctgaaggagttgaaactgc

SEQ ID NO: 6389 - DNA, 293 bp, Zea mays
  misc_feature: Incyte ID No: 700351713H1
  unsure 135: a, t, c, g, or other
ctccccgccatcaacgctctccatggaagtcgagtccgcgatgctcgcgtcgtccctaaaccccgccccgactctctccgcgtccgcgacaacccgatttccagcgtcctccaccccgaatcgccgccccggctntctccatggaaggcgcgtctgcgacagcccgatctccgtggaaggcgtgtcctcctccccagatcgtcgtcccggctctctccacgcccgtgacagcctgctctctatggaaggtgagtctgcgatgctcacgtggattgggtaccccgcccccgctc

SEQ ID NO: 6390 - DNA, 293 bp, Zea mays
  misc_feature: Incyte ID No: 700351714H1
gagagagacaggaccaagggagagaggagagagcgatcgagagatgaggagggagcttgcctcccccttagctactgccgccgctgccacggccggtgcctccttctcggctgccgcctcgctccggggctggtgggacgatgtcaacgagtcgccccagtggcaggacggggccttcttctccctcgccgccgcctacgccctcgtctccgccgtcgcactgattcagctcgtcaggatccagcgccgggtgcccgagttcggatggaccacgcagaaagtcttccacctca

SEQ ID NO: 6391 - DNA, 186 bp, Zea mays
  misc_feature: Incyte ID No: 700351715H1
  unsure 165: a, t, c, g, or other
gagcctcttctgcctctcatccccctacttccaagatgcaatcatgctgccccagactcctcgggccctcggccaccatgattgcctcaccgcctctcatgagtcgcctccacctacttccaagaggaagaggccggagaagctatagtccatgaggaaattaancggaggggcggcggccggtga

SEQ ID NO: 6392 - DNA, 300 bp, Zea mays
  misc_feature: Incyte ID No: 700351717H1
atgaatttatggaagaagattccaaaattacagatgaagaagatgaagatagctttgttgtgcctgatggctatctatccggacaatgagggaatacaaattgaaagcctattggatgataaagatgaggaagccagtagctcaccaactggtcagtgtgcagaagttgaagagttcaggtctctactgcgccaacaaagagtcctgaacattttaaccgagcaagctctccggaagagccaacctcttattatatccaacctaaatcatgaaaaagctgaattactgactgccgaagac

SEQ ID NO: 6393 - DNA, 303 bp, Zea mays
  misc_feature: Incyte ID No: 700351719H1
tgcaaaacaggaattcagtgacccccgtgatgctgatgatgcgcagtacaacctagatggcagggaagtcgatggaagccgtattattgttgaatttgctaaaggagttcctcgtggttctggtggttcacgtgagtacatgggaagaggacctccaccaggaacaggtcgttgttttaactgtggaatggatggtcactgggcaagggactgcaaggctggtgactggaagaacaaatgctaccgctgtggtgaatcgggccatatagagagaaattgccagaacagtccaaggaatctcag

SEQ ID NO: 6394 - DNA, 294 bp, Zea mays
  misc_feature: Incyte ID No: 700351720H1
  unsure 36, 41, 193, 195: a, t, c, g, or other
tcgaagtgcgctgtggcctgtggactctcccctccncaacnccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccancnaccgcctcggcatcgacctctccatacccgaccgcaagctcttcgtccgcggcgtcgttgaggaatacctactttcatctcctccaaggaggaggcgaa

SEQ ID NO: 6395 - DNA, 292 bp, Zea mays
  misc_feature: Incyte ID No: 700351723H1
aaatactgtggtaaatattactgggaaccaacctgaagattggcagagtcaaacaggacatggtcagttaagtggacgtttctcaattgttgaaggagagccttttacagtaacactgtgggctggtgtagaggggttccatatgacagtaaatgggcggcatgagacatcatttgcctatagagagaggtcagagccatggttggtagcagaagtcatgttttctggtgatttggagctcttgtcattcttggctaatgagttaccagtatcagaagatatagacatggaa

SEQ ID NO: 6396 - DNA, 292 bp, Zea mays
  misc_feature: Incyte ID No: 700351724H1
  unsure 168-191: a, t, c, g, or other
tgactgactgaaactgagcactagggctttgagagtgcagcagaggagggcgaaccatgggcgaggaggagaaggcgaaggaggcggcgcccccggccgacaaagtaaaggaggcggaggagaagaagggcgaggggggaggaggggaggagaagaagaacgaggccnnnnnnnnnnnnnnnnnnnnnnnngaggaggtggtcatgcgggtcttcatgcactgcgagggttgtgcgcgcaaggtcaagaagattctcaagggatttgatggtgttgaagatgttattgcaga

SEQ ID NO: 6397 - DNA, 297 bp, Zea mays
  misc_feature: Incyte ID No: 700351727H1
  unsure 8, 207, 288: a, t, c, g, or other
ttgcattncattccttcagttcagtagtgtgctctgacagtgagatggcgagcgtgaaggttttcgggtcacccacctcggcggaggtcgcccgcgtgctcatgtgcctcttcgagaaggaggtggagttccagctgatccgcgtcgacgcctaccgcggcaccaagcgcatgccccagtacctcaagctgcagccgcaaggcgagngcgctcaccttcgaggacgagagcctcaccctctccgactccagggggatcctccgccacatctcccacaagtacgcgaanaggggcaac

SEQ ID NO: 6398 - DNA, 288 bp, Zea mays
  misc_feature: Incyte ID No: 700351728H1
gcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaa

SEQ ID NO: 6399 - DNA, 219 bp, Zea mays
  misc_feature: Incyte ID No: 700351730H1
ggtggtcgcacatggcctcttacccttctgtctcccctcgtggctccggctcggtgcaggtcgggcgcgccgagctttactcgaagatggcgcgtgacctcgacgagcgcggcgcggcgttcctgaagggcggcgagacgtcgcagtcgctcacgctctcggacctcttcgacaccgcagatgacggcggcgtcgtacccaggctcaaggccgccgacc

SEQ ID NO: 6400 - DNA, 289 bp, Zea mays
  misc_feature: Incyte ID No: 700351731H1
  unsure 3, 36, 39, 41-42, 48: a, t, c, g, or other
cgngaaatgcataccacgctgtctacaaacaaagtntcncnntcgctncatagaatgctcactccagacaagcacgagtttctgttgccttgttctatctgtaaactgtggaactattttaccttaaagcctgaaaacagttttgtggattaaattttcttcatgctgttgtattttctgatcattggcttcctaacatggttgtactacaatatatttggttgattgagttatacattctcaaaactcagtgaattctatgattttagagtatcatttgtttgaacta

SEQ ID NO: 6401 - DNA, 292 bp, Zea mays
  misc_feature: Incyte ID No: 700351734H1
gtgtgataccaaaccccagcagcagtgtccaatactgcaacgcttgaggagtcttctaccatgcgaccacccccaagagcccctcctgagacatgaagccgtgcattgacaaaaacagctgcatgttgatatctgggtgatggagacacaccaggggcaattgcccactcccagcgtccatctctatgcttagcaagcccatatgcacttgatagtggcacactattggcatcccttccaccacaaagcaaaaggaggccatcagaacgggcactagcagatctagcaagat

SEQ ID NO: 6402 - DNA, 287 bp, Zea mays
  misc_feature: Incyte ID No: 700351738H1
  unsure 100-126: a, t, c, g, or other
gctgtcgatccaattgtcacttgctctccctccaacaagctaattaaggccggtcgtcatccctcttctagctcgttttattatccatggcggaggagannnnnnnnnnnnnnnnnnnnnnnnnnnataagaaggacgaggagcaggaggagcagctcgccggcggcggtacggcgagtccgccgagtacacggaggccacggtgacggaggtggtgtccacgggcgagaacgagtacgacgagtacaaggaggagaagcagcataagcacaagcagcacctcggcg

SEQ ID NO: 6403 - DNA, 285 bp, Zea mays
  misc_feature: Incyte ID No: 700351739H1
  unsure 79, 173, 204, 232: a, t, c, g, or other
acaagctcaatgagccaaaagattacatgcctactgagcaaaatgctttgtcacagcatttacgtggcatgcgtaggcncagcttttcaatgaaaaggctgggcttagtaataaaggtgtagacaaagcttcagatcatcatcctgtaaattcaactacccccaaatgcaaanccatttctggtgacaactcaaagactctaanaacccccccatgtgcattgcctggtatnggcttgcacttgaatgcccttgccgcaactgcaacacctaaagagaaaatagt

SEQ ID NO: 6404 - DNA, 269 bp, Zea mays
  misc_feature: Incyte ID No: 700351740H1
  unsure 2, 4, 15, 18-19, 23, 29, 35, 44, 54, 58, 65, 72-73, 90, 92, 118, 207,: a, t, c, g, or other
antncaaccgcagcncgnncgcncgcctncgcacnggcagcganctctatctcncgcnacgagangcagctnncaccgacgcacgcagancnggcaataaatattggtattggtagtntgatatctataagaagtcaagatggtgaagttcacagctgaagagctccgcgctatcatggacaaaaagaacaacattcgtaacatgtntgnnannnnnnnnntngacnatggcaagtctacgcttacagattcccttgtggcagctgctg

SEQ ID NO: 6405 - DNA, 282 bp, Zea mays
  misc_feature: Incyte ID No: 700351742H1
  unsure 2: a, t, c, g, or other
gnacatcgtctgaaaaatcatgaatgtgctcttgctcgcacactagtttcaggatatcagatccgccgcagactacttttaactggcactccaatccaaaatagcctacaagaactgtggtctttgcttaactttattctgcccaatatttttaattcatctcagaattttgaggaatggtttaatgcaccatttgcatgtgatgttagtcttaatgatgaggaacagctattaatcatacatcgtctgcatcaagttttgcgtccatttttgctgaggagg

SEQ ID NO: 6406 - DNA, 281 bp, Zea mays
  misc_feature: Incyte ID No: 700351745H1
  unsure 153: a, t, c, g, or other
cagaatgttatccaaaggaaatattttgattggccatagcttacatagagatttatgcgccttaaagattgattactctcaagttattgatacagcatacatatttaagtatgcaaatttaccaactactgcatcaccttccttgaacagtcngtgcaaggctattttggggtattcagttcgagaagaaggagaaccacataattgcttgaaggatgcagaagctgcgatgaatctagttcttgcaaagcttaagaatgagtttaatgaccccattgaaa

SEQ ID NO: 6407 - DNA, 280 bp, Zea mays
  misc_feature: Incyte ID No: 700351746H1
catttagctgcaaataaatggagcatgtcattactgtgcttgttgattccctgttttctattaagtctaagttctgtttatatgaatatttgtacgtaagattgcattgttcttttgtatgaggctgcatatggcgaggcgatgtctagtcagcacggaccagacttattgatcatcaggctgtgtatgcaagtggtggaaaagctcatggaaggtacacaatgtttgctaacgttatcgactcgagccacgtgagggttcagtgtggaggttcatcgag

SEQ ID NO: 6408 - DNA, 282 bp, Zea mays
  misc_feature: Incyte ID No: 700351747H1
  unsure 34: a, t, c, g, or other
gaagacaaaagcataatgataatgctagggagtncaatacagagttttttattacagtacataatggcattcacaaactgaaggtaagcaacaccagctttattcacatactgcttaccatctcattagataagatggtagaacagctgctgatgccttagccactagccagaacagctgctgatgccttagcctcatttagcatggatggctccgaggaaaccttatttctgagctgcatagctttctggtacatagatctcccctcctgcttcaccatgt

SEQ ID NO: 6409 - DNA, 153 bp, Zea mays
  misc_feature: Incyte ID No: 700351751H1
  unsure 7, 60, 120, 127, 136, 143: a, t, c, g, or other
gatgganatgggcttcatgaagccaacgatggaggtcttcttgctgcaatcatggctgcnggctttaaaggtgaactcagtcggttccaacctggagtttcgatggcaatttcacggctngatgctnggtattctnaccggantggttccgtg

SEQ ID NO: 6410 - DNA, 187 bp, Zea mays
  misc_feature: Incyte ID No: 700351752H1
  unsure 142, 153, 178, 183: a, t, c, g, or other
gttgcatccactcagttggatctaatcttactcgtactagggagctactagagttgtagtagaatgtgttcatgcagagcgggcaagaagctttcacagtgggtaaggattcaaacaggactccaacaagtgtgcatgagcncggttgtaccnatttgttcccctggaaactggagtncttgnaaaa

SEQ ID NO: 6411 - DNA, 279 bp, Zea mays
  misc_feature: Incyte ID No: 700351754H1
  unsure 3, 42-43, 56, 58-59, 64, 77, 111, 117-118, 143, 149, 151-152, 158, 211,: a, t, c, g, or other
ctncttgagctgaagaattctgagcttaacaatgaacttaannagaaggaattgtnannaggancagttggcagagngggcacgcgctgctcagttggaaagggatcagangatgcnnaagattgaatctgtgaggaatgganaatcangnntgatantgaaaatattgataacgaccaagagttgatttttgaagggctacatatcaaanatanagntgttggnnattgangtatgttcaaanctnctccaangtggtggcntnctnngggggngtnt

SEQ ID NO: 6412 - DNA, 274 bp, Zea mays
  misc_feature: Incyte ID No: 700351756H1
  unsure 16, 41, 235-236, 242, 249, 253-254, 256, 261, 265: a, t, c, g, or other
agacaagcatgcgcanttacttcatgcacgcggtggaggcncctcgctgtgtggcggcctcggcccatgaaggccgggtgcatgggggcaacttcatgcctatcatgctcgacggtggcgtgggactcgggaagaggccggccgacaacgctgatgctggtgcctctgcccctcctcgcagctggaaaagtatagagaaggcctgtggatctgcgccgcgcacttgctgtatatnngccagngttgtgnttannanttttnggtnggggttgtt

SEQ ID NO: 6413 - DNA, 108 bp, Zea mays
  misc_feature: Incyte ID No: 700351757H1
  unsure 11, 14, 17, 26, 104-107: a, t, c, g, or other
caaaacaccancancancaaagaacngcgagaacgcactacgtccctccccttccccttacccctccaggcttccaggaccgtctcctcgccagctcatctacnnnng

SEQ ID NO: 6414 - DNA, 137 bp, Zea mays
  misc_feature: Incyte ID No: 700351758H1
gatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgt

SEQ ID NO: 6415 - DNA, 285 bp, Zea mays
  misc_feature: Incyte ID No: 700351761H1
  unsure 244, 264, 276, 282: a, t, c, g, or other
atgacatgcatgacattaggtggccgtgctgcagaggaggttttgattggcaaaatctcaactggtgctcagaatgacctggagaaagttaccaaaatgacatatgcacaggtcgccgtgtatggttttagtgaaaaggttgggcttctgtccttcccccagaaagatggtggtttcgaattgagcaagccttacagtaatcagacagcatccatcatcgacgatgaggtccgggaatgggttngcaaggcctacaagaaaacngttgaattgatnacaganccg

SEQ ID NO: 6416 - DNA, 183 bp, Zea mays
  misc_feature: Incyte ID No: 700351764H1
  unsure 7, 68, 113, 161, 170, 181: a, t, c, g, or other
ctaagangcaggagcacgcggggagcgacaagtcgtgcgtgtggcacgcgctggacttcgccgacggnagcttcaaagaggagatgtttgctatccgttttggatctgtcganagtgagcacctagaaccatatcttacctgcctcttaatcccttcttgnatgtgttcngaagtaagaantt

SEQ ID NO: 6417 - DNA, 95 bp, Zea mays
  misc_feature: Incyte ID No: 700351768H1
  unsure 9, 37, 82: a, t, c, g, or other
gctgacgangtggggcccgtgcgggccttgaccaatncggagtttcgacaacagcctggccacccaacaaaacaacacactncctttcgccttcg

SEQ ID NO: 6418 - DNA, 184 bp, Zea mays
  misc_feature: Incyte ID No: 700351771H1
  unsure 4: a, t, c, g, or other
aganatatggagggtggttaagcgcgaagatggcggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgg

SEQ ID NO: 6419 - DNA, 278 bp, Zea mays
  misc_feature: Incyte ID No: 700351773H1
  unsure 84, 187: a, t, c, g, or other
tcattccagttacagtcgcttctgtgctgtctgggctggcctcttcattgtgtcagtgggcatctcaggttaaaaaacataccncttatatgatgaccatagagatgtcatttattggaagtatgtgcttgttagcaagtacctatcgctcaccagatggagaggccatcaggaaatatggattttnccatgaatggactttctggactgtgataccggtattaatgaatgccgtgggtggaattcttgttggtcttgtcacaacttacgcaggtggg

SEQ ID NO: 6420 - DNA, 217 bp, Zea mays
  misc_feature: Incyte ID No: 700351774H1
  unsure 13, 201: a, t, c, g, or other
ccgggtgtctttngaggttccctgatgccggccacttgatactcattgtagggacaacaccccagtgcccgtgtccttgatcagtctgttgtgtttgcgaagtgtgaataagatataggactgtttgattcccggtacagcgcagggtttcagcagaaagggctggatggatgatgttttgtggcgatgctgcctcttgantctttaaaacgggtgt

SEQ ID NO: 6421 - DNA, 277 bp, Zea mays
  misc_feature: Incyte ID No: 700351776H1
  unsure 265, 269, 272: a, t, c, g, or other
ggcgctcggtgttgataccgtgccagtacttgttggaccagtctcgtacctgttgctctcaaagcccgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtattntganttnatggg

SEQ ID NO: 6422 - DNA, 276 bp, Zea mays
  misc_feature: Incyte ID No: 700351778H1
  unsure 208, 244, 246, 257, 264, 270, 273: a, t, c, g, or other
agaaggctttctttgatgactacaaagaggcccacctcaagctctccgaactggggtttgctgatgcttaaatagaccctatcttggagtgataacttctgctgcctgtatggaatcatgtggtcttttgcatctggagtcaatgtgaacaagcagattgtcgtattgtctttctcgtaataaatttgtcgatgttgagcccttagcngttgttggtacattggtacttccgtcgatgcttgantngggacccttgncggtttnctagantcntga

SEQ ID NO: 6423 - DNA, 117 bp, Zea mays
  misc_feature: Incyte ID No: 700351779H1
  unsure 31: a, t, c, g, or other
gcagaggggtccatacggcgttgttctggantcccgtcgtaacttaaagggaaactttcacaatgtccggagcccttgatgtcctgcaaattaaggaggaggatgtccttaagttcc

SEQ ID NO: 6424 - DNA, 121 bp, Zea mays
  misc_feature: Incyte ID No: 700351780H1
  unsure 30, 37, 44, 65-66, 72, 75, 91, 108: a, t, c, g, or other
ctgaaaccaaccagatcacacgaaccaaancaccgcntcctccnccgaccggagaggagcctcanngccggngcncatggcgacacgctanttgatcgtgttgctgcncgtgcatcgccgg

SEQ ID NO: 6425 - DNA, 282 bp, Zea mays
  misc_feature: Incyte ID No: 700351781H1
  unsure 12, 52, 86, 108, 114, 119, 167, 190, 197, 204, 212, 223-224, 241, 244,: a, t, c, g, or other
tcgcgtgccatnctagggtttctttccccgtcggcgcctccccagatttggncgccgccgccgctgacccaggttgtcttgatggngcccgctgtagaagccgtgaangagacnggcancttccagaaggttcctgccttgaacgaaaggatactgtcatccatgtncaagaggtctgttgctgcaaacncttgggntgatctngaaatagncctggtgctcnnaccatatacaactgggntantnngtanggggggcanccggtttnntgntttanaaaaa

SEQ ID NO: 6426 - DNA, 271 bp, Zea mays
  misc_feature: Incyte ID No: 700351784H1
  unsure 20, 47, 55, 63, 68, 128, 170, 175, 177, 192, 194, 200, 209, 216, 249, 252,: a, t, c, g, or other
ttcacgtcttcctcctcgcnttcctctcgtcagtacggcgacgccgnaaggtccncaccgctnacatnaacttttcccggatcgagcctctcttttcccagatcggattctaattgggctatcgccgntcccgtgccaggtgccgagtccttagccgattttcgccggcnaggancncccaccaggagttananactgantgacaagantgttctntatatctctcatattgtgaagaatatctgtaantanannacctttattgnnttng

SEQ ID NO: 6427 - DNA, 278 bp, Zea mays
  misc_feature: Incyte ID No: 700351786H1
  unsure 186-187, 224, 259, 269, 271-272, 274: a, t, c, g, or other
aacgatacaggaatacgatacgccgctcgcctgaatcgagaccaccaccgctcccgctactgcctcaccttcgccgactagagtttttgccgccgcggatctcgccgtccccgccatggatacgtcgggctcctccgcagccgccggcgacgccccgaccaccggggagcaccggatggggaccannattgtcggggtctgctacgagggtggcgtcgtctcgncgctgattccagaaccagcatggaatgtatgtagncaaccgtgcnannanacaa

SEQ ID NO: 6428 - DNA, 276 bp, Zea mays
  misc_feature: Incyte ID No: 700351788H1
ggagggaaccgaaaactcagggtctcgaatttcctaggagcggaggcgatggctgggaagggaggaaaaggattgctacgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgc

SEQ ID NO: 6429 - DNA, 221 bp, Zea mays
  misc_feature: Incyte ID No: 700351791H1
  unsure 25, 42: a, t, c, g, or other
gagccggaacgggaaatcgcagcgntctctgtttccacattnccagtttgaagtctggtactgtggcggctaccgttgtgctttggcgttccttttgcgacagtttttgccctggtgcaggctggtgcttggtgcccttttggttaataaactgcgctgcaacgaaatgtggtggtatattgttcagttgaaggccggggctgtttgtcccttgaactcta

SEQ ID NO: 6430 - DNA, 210 bp, Zea mays
  misc_feature: Incyte ID No: 700351792H1
  unsure 2-6, 40, 51, 55, 81, 90, 92, 94, 123, 126, 130, 136, 167, 176, 190-191,: a, t, c, g, or other
tnnnnnctgtcaacaactgtagcgatttaagaactgatcntgggggatcanaatnactatggtgataccacaggggcgaanagttctgcncnanccaatccacatctgttcaccttaagtagngangctngggtgngtcaatatttacgcagcctcagtgcctcagnaaaggtganggatttatctgatnngcagctttnagtntnttgg

SEQ ID NO: 6431 - DNA, 275 bp, Zea mays
  misc_feature: Incyte ID No: 700351793H1
  unsure 46: a, t, c, g, or other
cttccgtctcggagcgagaaatcagcggcatcgccggcgcatcacncagcgcacacgacaatgcagggcggatccagcggcatcgtctatggtggcctcaagtaccaggcacggtgtatcgccgacgtgcgcgcggacgccagctcgaccaccttcctcgccgggaccctcagcctcaaggaggagaacgaggtgcacctgatccggctttcgccggcggagagtgagctggtgtgcgatggagtttctaccaccccaacgagatctgggatctc

SEQ ID NO: 6432 - DNA, 167 bp, Zea mays
  misc_feature: Incyte ID No: 700351794H1
gaagccacgacagacgcctctgctctgactttgctttttaaatctgatccacccatcgagacccccgcatctcagttggccttcctgcccggagatgctgaagcaggcagtggaacacagaggaggcttctctttcgagaactgccagaggaatgcgtcttggaaca

SEQ ID NO: 6433 - DNA, 132 bp, Zea mays
  misc_feature: Incyte ID No: 700351795H1
  unsure 47, 114: a, t, c, g, or other
aagatgtatctgtatcaaaatgttattatcaaggagtatgtttaatnatgtttattaatgcctgacctcccaccttgatgtttttggacagttaaaaaaaatgtgcagtatctnactttcaaagcattgaaa

SEQ ID NO: 6434 - DNA, 282 bp, Zea mays
  misc_feature: Incyte ID No: 700351796H1
  unsure 64-87, 92, 100, 111, 116, 135, 144, 161, 186, 231, 241, 243, 258, 272-273,: a, t, c, g, or other
cgggcagggagagcgagaacggagtgtggaagatggagacggtgaagagccttctgaagccaannnnnnnnnnnnnnnnnnnnnnnngcganttgcagcnccgcctccgcnacganggccgctacatcgaccggnagatccganatgtgcagagggagganaagaaggtggagatggccatcatgnaggccgccaagcgcaacgacatggggatccgccaaggcgctggcnaagtggtgtncnccccagtaagcatcnaccccctgttcgannanaaagncc

SEQ ID NO: 6435 - DNA, 302 bp, Zea mays
  misc_feature: Incyte ID No: 700351803H1
aagaaagaggagcgccagcagggcagcgcagaaaatcagtacaccaatgatgtcaggatcaacaaggaaaaccatatctttttaaatgtgaagtgaacatacgttcacggaagcaagaaattttactagagtattctgcagctgacacttggagcaaggaatttgatgctatttagaattcttcattgaaggtctgatttggttcaataatcattttaagaaactaacctcaaaaacaggcaagctatatcttctgagtctactgctggtgtcaaggtacattccaatattttcttccagag

SEQ ID NO: 6436 - DNA, 300 bp, Zea mays
  misc_feature: Incyte ID No: 700351804H1
  unsure 35, 130: a, t, c, g, or other
cgaaatatctcgttatatgcaatatagtggttganttcatatgggtgaagtagccgtggcttgggaaacctaggtctaaggtacaaatgatgcgaggagtgcttaggtaaacatgtatgtctaatgggantggggttcgtgatggtggagtaaacgcgtcgtgtagcagagtttggtttgaggtgtatggtgatatgcctctatggtatgtcatgatttaggcaccgtagtgttcaggatgtagacgttctatttattgtgaattttaggtttaaggcacaagatatgtactgtataatt

SEQ ID NO: 6437 - DNA, 298 bp, Zea mays
  misc_feature: Incyte ID No: 700351805H1
ctcagattgcttcaactgcctgcctattgcagcgctcattgatgacaagatactgtgcatgcatggtggtctctcaccagaatggactagtttggatcagataaaggatattgagaggcctgctgagattcctgattatggtctcttgtgtgatctgctttggtctgatcctagtcctgatggagaagggtggggggagagtgacagaggtgtttcgtgtacgtttggtgcagataagctcgtagagtttttggagaagaacgatctcgaccttatatgccgagctcatcaggtagtt

SEQ ID NO: 6438 - DNA, 298 bp, Zea mays
  misc_feature: Incyte ID No: 700351806H1
  unsure 4, 26, 39-41, 47, 63, 96, 227-229: a, t, c, g, or other
catnctcaagaggccaccttgcatancttcctcacagannncttctntgttcctgaaaggtanatttcggtgcaggtctcatagaataagcacatnttacagctctgggcaggctattctagtcacaggtcctcatggtccgggctccagggagcacctggaagcagattgtatcccccgagtatcacttttcaggagcagggatgaagtggcagctgcctgctgcnnntatctgtcacattcactaccctgaaacaggacacactcttcaagaatcaccaataaccagagttcgtcc

SEQ ID NO: 6439 - DNA, 201 bp, Zea mays
  misc_feature: Incyte ID No: 700351807H1
  unsure 12, 20, 74, 92-93, 95, 100, 111, 114, 121, 125, 127, 144, 149-151, 162,: a, t, c, g, or other
acaaactcaganacagacancatggtgcacctgactgatgctgagaaggctgctgttaatggcctgtggggaanggtgaaccctcatgatgnngntggcnaggccctgggnagnctgctgnttgncnacccttggacccagagnaattnnntacctttgggnacngtccgnngcctctgcaaccatgggagnncccnaagg

SEQ ID NO: 6440 - DNA, 296 bp, Zea mays
  misc_feature: Incyte ID No: 700351808H1
cgtcggttcacttctccaggtaaggaaagggttcgtactcatggcgccgccgcagccaaagtcgggccttttcgttggcatcaacaagggtcatgtcgtcaccaagcgcgagtgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggc

SEQ ID NO: 6441 - DNA, 298 bp, Zea mays
  misc_feature: Incyte ID No: 700351810H1
gtccgcatacgcctttccacactcgaaactggtcgtgtgtacacccactcgtatcctcttctggttctacattccgtcgggggtcaaaaagatgggcgaactgcacctggcaattcgattttcctcaacatctctggtaaacatgttgtacctgtattctaggcccttgcttccaaaaatgcactatgtgcgcccaatacctgtgcttcaggttgatatgctacgccatcaagctgtccagattgtggctgcccgacttagccggatggagccacctttgagaaaggaagttgttgaa

SEQ ID NO: 6442 - DNA, 298 bp, Zea mays
  misc_feature: Incyte ID No: 700351811H1
  unsure 3, 32-33, 44, 61, 66, 72, 94, 146, 173, 221, 227, 253, 293: a, t, c, g, or other
acnccaagcaactactcgtacgcggaaagagnnacccagaagcnggtcttgttggattatnccgtncgtcanttcccgtccggagcggcggagnaaaaatgagtgacaacctgatggacaaggttagcgcctttggtgagcgcttnaagatcaccgggacagaagtcagcaanaagatgactgccggaatgagctccatgagtttcaagatgaaggagttnttccangggcagactccagctgacaagattgntgagggtgccacctcagaggatctggacgggcctgactgnaactc

SEQ ID NO: 6443 - DNA, 294 bp, Zea mays
  misc_feature: Incyte ID No: 700351813H1
  unsure 6, 8, 25, 32-33, 36-39, 42-43: a, t, c, g, or other
cctatncncatagtaaaacccagcncatgacnnctnnnntcnngccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactc

SEQ ID NO: 6444 - DNA, 288 bp, Zea mays
  misc_feature: Incyte ID No: 700351814H1
  unsure 48, 66: a, t, c, g, or other
atacgctcgagtgccattcgccgtgcggacactccgggccctccacanttttccccctctccctanccagtaccggcgccgctggccgactcccgtggcgacaacctgagaccggagcgccataatcctccggattcgagacaccgagcgcaccgcgaactttatctgctgtgtttggagctgaaaatgagtgaggcgaatactactcagcttgaccttgagaaaggattttctcaagtgtctaatgataatgattcgagtagccctgcgaccatgcacaagatgaaa

SEQ ID NO: 6445 - DNA, 299 bp, Zea mays
  misc_feature: Incyte ID No: 700351817H1
  unsure 247: a, t, c, g, or other
ctaccagcgactcagcgagcgagagcagcacacacgcagctagctaggagcagcagcagagcagcggcgatggcggcctccatgatctccttcgtcagctctggcggtggcgcctcagggcctgccgcccctccggccgccgcgcctcctccttcgccgtcgtctgctccaagaagaagatcaagaccgacaagccctacgggattgggggtggctgaccgtcgacgtcgacgccaacgggagaaanggcaagggcaagggcgtgtaccattctcgacaagtacggcgcgaagtcgacg

SEQ ID NO: 6446 - DNA, 68 bp, Zea mays
  misc_feature: Incyte ID No: 700351818H1
  unsure 35-36, 41-42, 44, 46, 59, 67: a, t, c, g, or other
aaaaacgggaactctatatacattacaaaataatnntttcnntncnttttagcgacacnggtttaanc

SEQ ID NO: 6447 - DNA, 294 bp, Zea mays
  misc_feature: Incyte ID No: 700351819H1
  unsure 127, 278: a, t, c, g, or other
ccttcctccgtcaccagacagacggtagagagtcgaacaatcgccggctcgacgcccctgcttcccgacgccgcacgccttcactgtcctcggcagccgatcttccagagcggttcgacaccgtgcncgccacggtcgacatcactgccgccgccgccggaaagttggcatcgttgtcgacctctttctccccttcttccacccaggaggcaacatgtcgtcgctcgccgctgcgagagcggataattctactatccgccggaatggagccccaaganggtgggtgaacaattc

SEQ ID NO: 6448 - DNA, 295 bp, Zea mays
  misc_feature: Incyte ID No: 700351821H1
  unsure 290: a, t, c, g, or other
tacgagcccgttcgcgagatcgggggcgggcaacttcggggtggccaacgctgatgaggaacaaggacacgagggagctggtggccatgaagttcatagagcgaggaaacaggatcgacgagaacgtgttccgcgagatcgtgaaccaccgctccctccgccaccccaacatcatccggttcaaggaggtggtgctgactcccacgcaccttgcgatcgtgatggagtacgctgcgggcggggagctgttcgagcgcatctgcgacgccgggcggttccacgaggacgangcgcg

SEQ ID NO: 6449 - DNA, 286 bp, Zea mays
  misc_feature: Incyte ID No: 700351823H1
  unsure 44, 51, 58-59, 62, 67-68, 71, 95, 102, 111, 125, 132, 184, 198, 218, 220,: a, t, c, g, or other
ctgcattctcgaattacgattcccaatccagcaaaccctaacanccttttncaaactnnganaaggnnccngttggaacccaaggcggagaagangccggcngcgaagatncccgcagaggaggngcccgcngccccggcggagaaggcccccgctgggaagaagccgaagggaagaaagcggntcccggcgggaaantccgccggcaaggaaggcgntnttnacaagaaggggcggaanaaggccaagaagaccttgnaaattaantnttattttncaggtgtga

SEQ ID NO: 6450 - DNA, 292 bp, Zea mays
  misc_feature: Incyte ID No: 700351824H1
gacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgg

SEQ ID NO: 6451 - DNA, 297 bp, Zea mays
  misc_feature: Incyte ID No: 700351825H1
  unsure 101, 122: a, t, c, g, or other
gggacgaatgcagccgccgttgcgggcgcagggagcaatggctaacgtcgccgctatcctcaccgtcccctgctccgcgggccgccgcccgaacgcggagnagccagccccgcggatgcggntgccgtcttccgtctccgtccgtgcgtcctctggcgcaaacacggtgactctgctggactacggcgccgggaacgtacgcagcgtgcgcaacgcaattcgctacctcggcttcgacatccgcgacgtgcagagcccggaggacatcgtcgccgcggaacggctcgtttttcccgg

SEQ ID NO: 6452 - DNA, 294 bp, Zea mays
  misc_feature: Incyte ID No: 700351826H1
gtcttcttcgggccccttgccggcgggaactcaccagaccaggaatcgtgctggcaaccggcgcaagttctggagatagggctgataaagctaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtaca

SEQ ID NO: 6453 - DNA, 298 bp, Zea mays
  misc_feature: Incyte ID No: 700351827H1
  unsure 5-6, 8, 10, 80: a, t, c, g, or other
cacgnnantnagcacccaggccgccactacgtcaagcacaccacaacctccgcctcccccaccccctccagagaagactncactttggtggcctcaaagacgaggatcgcattttcaccaacctctatggtctgcatgacccttttctgaaaggcgcgatgaagagaggtgactggtataggaccaaggatttggtgatcaagggggcagactggatagttaatgaaatgaagaaatcaggtcttcggggtcgtggaggtgcaggttttcctctggtctcaaatggtcctttatgccc

SEQ ID NO: 6454 - DNA, 271 bp, Zea mays
  misc_feature: Incyte ID No: 700351830H1
ctcgagcgtagtgctatcaggcaagagctcgccaagcttaagaaggcgtccacagcttaaggagtctctttccgtgaatgtcatgttagagtttttggttatgagttggatcagcaattcgattgagcgttgtcaaagccagagttaccaatatgttccctgtgaacccatttcaaactttatcaagcacgggtgtgctcaggatatttttgccatgaatgatatggaatatctatggtgtaggttgcggcaaatgtgtaatgaggccgct

SEQ ID NO: 6455 - DNA, 295 bp, Zea mays
  misc_feature: Incyte ID No: 700351833H1
ccccaagcccttgccgccgcagctgccgcagccagcaacgaaccgtacataggcagggacgaagcgatggagggagccaatggagtcggtgggtcggagtccgagcggaagccgctgtcagaggtggtcggcgactgcgtccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtctt

SEQ ID NO: 6456 - DNA, 292 bp, Zea mays
  misc_feature: Incyte ID No: 700351834H1
aagattcttagtatacaagtgtacggtggtctccattctgccgagtacgaaaccatagtgcaaaatgctccgccaccgccgtcgtgtgagataactgatatttatggcttcaggaggtcgaggcctttatatggatcattcaggggaggcgttggtcagatgaagctatagttcaacattttctcatcattctgtaaaattctgaaaaagagtcatctttctgttcaactgcatctacgttgattgttttttcattgcgaacactctagtaggccattatctacggtttttt

SEQ ID NO: 6457 - DNA, 290 bp, Zea mays
  misc_feature: Incyte ID No: 700351836H1
gctgatgttgtcaccctgagctgttctactgctgataggcgccccattagagacgttgcaccaaagtatgccactttagctctgccaaggagaccgtctactgccgagaggcaccccattgctagagatattgcaccaaagaatggtttatcactcagaccttctactgcagagaggcgaaccattgctagaaatgttgaaccaaagcatgcaccggcacagaggccttctactgctgagagacgtcctgttaccagagagactgtactgaagcaagctaatgttgccaa

SEQ ID NO: 6458 - DNA, 287 bp, Zea mays
  misc_feature: Incyte ID No: 700351839H1
  unsure 225: a, t, c, g, or other
gtcgacctccaggttgagaaggaaagcatcgcgagttcgccatacggatgggttccaaagcgcctttctgtctcacgctcctcttgctgctcgccgcggcctgtggacctgctgcacatgccaacgatgctgtcttgaaggaacatatttcttcaaccaagattcctgcccgtctcaagaggggcagcggactatgctcggcctgtgaaaacttcacgagcgaancgttcacttatctcggcaaggaacagacacaggacaggatcgtggagttcctcatgatgctg

SEQ ID NO: 6459 - DNA, 287 bp, Zea mays
  misc_feature: Incyte ID No: 700351840H1
  unsure 65, 274: a, t, c, g, or other
ttggaggcccttcaagggactggattggtatttatgaggaatgttccaaaattttatatgaaganattgattacatcaatgaaggaaagaatgcggacaagtttcggcgggatttcagaaatataaagtgggttcgcgtgccacttatcatgtgggactacacaactgaaaaggtgctaaccctggagtatgcccctggtattaaaataaacaatttggatgtgcttgacaaccggggttatagtcgctcactaattgcatcacgtgcaatagnatcttacctaatt

SEQ ID NO: 6460 - DNA, 290 bp, Zea mays
  misc_feature: Incyte ID No: 700351841H1
  unsure 7: a, t, c, g, or other
ggcgcanagaagtctggtgtctcttgctccgaccccgttggcgactgagacgcgatccccttctcctgcactgccgtcctccgtcgctgcgatgcctcggtattactgtgactactgcgacacctacctgacccatgactcgccatctgtccggaaacaacataatgctggatacaaacacaaggcgaatgttcgaacctactatcagcaatttgaggagcagcaaactcaaagtttaattgatcaaagaatcaaggagcatcttggacaagctgcagctttccaagcag

SEQ ID NO: 6461 - DNA, 288 bp, Zea mays
  misc_feature: Incyte ID No: 700351843H1
  unsure 3, 7, 180: a, t, c, g, or other
ccncttnggactcgctgctgttcttttgcttggtacccttggatctctgactccagcccgttccccgaaatttccagttcttgcttcttcctcttggaggaggagggctgcagcctgcaggggccggagagagcaggaggaggcggagacatgggtagcttcgctaagctggcgaggagngcggtggagacggacgctccggtcatggtgaagatacaagaactgctccgaggggccaaggatgtgatgtcgcttgcgcagggagttgtttactggcaacctcccgag

SEQ ID NO: 6462 - DNA, 289 bp, Zea mays
  misc_feature: Incyte ID No: 700351845H1
gatacacagggaaagtggtttaaggcagacgacagccaggtgaaacctgtatctctggacaatgtcatgtcaaagtgtgcttatatgctgctgtatgcaagatgttcaccgagggcaccaagctctgttaggcaggctatgtccggacccagcacacccgaagcaggccaagcagaaggtggttccaggaggaccaacatggcgaggaggttccttcaacgggcaccaagctggccagcggcacagcgacgacgcggaagacgacgacgccacacatgctgcatttgac

SEQ ID NO: 6463 - DNA, 223 bp, Zea mays
  misc_feature: Incyte ID No: 700351849H1
  unsure 82: a, t, c, g, or other
cgatttctttgtcagcaactcagaatttggccaattgaaagaatctgatgcttgaagtttcctggttctgtgtacacaagtnggctcaatgtcagaattgagccgcttgaaatatatatatttatattctatgcggagagtaggtcttggaaacagccttttccacaataatgtacagttattatgccaatttatgagttcagttaaattttgtgaaaaaaaa

SEQ ID NO: 6464 - DNA, 292 bp, Zea mays
  misc_feature: Incyte ID No: 700351850H1
acgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaatctatcagggttgcccatggatgcttca

SEQ ID NO: 6465 - DNA, 293 bp, Zea mays
  misc_feature: Incyte ID No: 700351851H1
  unsure 31, 88-119, 193-224: a, t, c, g, or other
gagactgcagcagacgcctccaggatctgtncggcagctgctgttctgagggagagcagagaccatgtctgacatagaagaggtggtnnnnnnnnnnnnnnnnnnnnnnnnnnnnnnnncagctgttgaagagcaggaggaggcagcggaagaggatgctgaagcagaggctgagaccgaggagaccagggcnnnnnnnnnnnnnnnnnnnnnnnnnnnnnnnnaggctgaagatggcccaatggaggagtccaaaccaaagcccagtcgttcatgcccaacttggtgctccc

SEQ ID NO: 6466 - DNA, 294 bp, Zea mays
  misc_feature: Incyte ID No: 700351853H1
  unsure 44, 120, 136, 167, 203, 214, 223, 228, 243, 259, 266, 275, 283, 285, 288,: a, t, c, g, or other
cttagtattgcctttgatacgctgcaggtaattaaatcagggcngatcgaaatgtcactcattttgagtcctttccaatggccatttggcctggaatctttattttggttaatactagcngtctgttacacctgtngtatggatcttaaatatcgctacattctganacactatatgtggacctttttgtcattcacaattanttatctctaangtaaatgcnaaacnttcaacagatcatcnaagtcatagagattcnatattanaagccctangaaatacngnggngcntgg

SEQ ID NO: 6467 - DNA, 205 bp, Zea mays
  misc_feature: Incyte ID No: 700351854H1
  unsure 31, 178, 202-203: a, t, c, g, or other
ctccatttcccgcagcagggcccattggaangttggaattggaaacccaaaaagcataggcggggggtggcaggggaagcacggagcaagagattcgtttgctgccattattaaccgagccgagccgagagaggtcaagcaacggacccccattcgcatctgcctccttttccttggngccgaagaagagggaaaggaaggnngg

SEQ ID NO: 6468 - DNA, 285 bp, Zea mays
  misc_feature: Incyte ID No: 700351855H1
  unsure 262: a, t, c, g, or other
ccccgttgaagcctagggtttagcggctacacttctcttctagctagttggcgaccaccgtttacgctaaaccacccgcgcggccgatggacgtcgactcggacccggccgcctcgagcaagcccacgcagatggacctcgaggaccagacggacacaaaggggaagggaaaggcggaggaggggaacgggaagggcgaggaactcgcggatccatcggtagcctctctatcggcccggggcgcaccaatttcaagaagaanctgtgattatcatcgtcatcggc

SEQ ID NO: 6469 - DNA, 290 bp, Zea mays
  misc_feature: Incyte ID No: 700351857H1
  unsure 171, 182, 219, 255: a, t, c, g, or other
ctgccgcctgccgcatcctcccctcgcccaccgtcgacgacttgatcccctcccaccgttgaggccgcctacctcacggcagcgagccagcgactcctctcttcgtctcctacaagtagccagacaccactccgactttgccggcaacccgtcgacagcgacgaggcgcanataaggcatangggcacggcggccatggcgaccagctccaaacccgcngcgcccgtggaccccatggtcgtgctcgcccacganttccccgaggtgtcattcgatacgacgagagggat

SEQ ID NO: 6470 - DNA, 210 bp, Zea mays
  misc_feature: Incyte ID No: 700351858H1
gatggattctcaagcgccgcttcgtcctcctctagctttcgcctgcttcatcttcctttgctcatccttctgcgcacaaatgagatgtacgacagggttggtgcggcggcgtcagatggggagagcaggaggatgcggctgcacaccgacgggagccgcggcgacgcgcacgcgtggcctgggtacctctacacccgagcagttgggaga

SEQ ID NO: 6471 - DNA, 284 bp, Zea mays
  misc_feature: Incyte ID No: 700351859H1
gggacgaggcggcgaaaaaggagatcaaggacatcttcatgcgctacgagcgcaccctcctcgtcgccgacccccgccgctgcgagcccaagaagttcggcggccgtggcgcccgcgccaggttccagaagtcctaccgctgagcgagagcgcttgccggaccgctgtcgtggctccgtttgctaccatcgtagctacgactttacagaagttcagtctgataataacatggttggcgattcgtaggcttctcaggctttattttattttattttagtttatgg

SEQ ID NO: 6472 - DNA, 268 bp, Zea mays
  misc_feature: Incyte ID No: 700351861H1
  unsure 35, 195, 267: a, t, c, g, or other
tgccctgccgctgctgtcctgcacgggcgtccccngatttacaacccttaggctgcagttgcaagagccggattgccaggtcagtattcaaaaatgggtgatccaagtgagaggaatggacacggcgctcttacccgggtgctattctgtggtccatattggcctgcttctactaactacaccagggagtatttncaggactatccattcattcaggttgatgaagtaggtcttgagcaggtacctgatgttattcacagtaatcana

SEQ ID NO: 6473 - DNA, 283 bp, Zea mays
  misc_feature: Incyte ID No: 700351863H1
atcacagcgtcgaaacactggatgaagccactgaagcgctcaggaggataatcagcaagtctaggtggcacacaaagagctcagtcataggacgcccttgaaagctgaagctggaggctctatagaacagtttgtacagtgcggcagcagtctctactatggtatgtgccaataagaggaactccgttccagagtttcgtctactgccaagggcctcgtgtttgtgggtgggttgaataaacacgcaatttgagatgacgctgttttgaccatgaatttagat

SEQ ID NO: 6474 - DNA, 285 bp, Zea mays
  misc_feature: Incyte ID No: 700351864H1
  unsure 2-3, 28-29, 51, 114, 117, 152, 209, 281: a, t, c, g, or other
cnnatggaggcatgagctccgccgcctnncccgtctctcgccgatctcccncaaaccctagcctcgacctgaccgccagcgggcccgcaggccggagaaggagtcggagtcgcnccnacccacccaccctctgccgcgggcggggagcgggnggcggacgagatgccgtcgcacggggatctggaccggcagatcgcgcagtgcgcaantgcaagtacctgcccgaggcggaggtcaaggtgctctgcgacaggccaaggccatcctcatggaggaatggnaacg

SEQ ID NO: 6475 - DNA, 292 bp, Zea mays
  misc_feature: Incyte ID No: 700351865H1
cgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaaacagcctggtcaatttgtaactgcaggcctctaaaacctaacctctctctgggtt

SEQ ID NO: 6476 - DNA, 278 bp, Zea mays
  misc_feature: Incyte ID No: 700351868H1
  unsure 55, 234, 277: a, t, c, g, or other
cagatcctgccttgcactgcaagcaaaccacccgcaagcccttactaatttaggnaacatatacatggagtggaacatgataagcgctgctacttcattttacaaagcagctatatctgtgacatctggattatcttccccacttaacaacttggctgtgatatacaagcaacagggaaactatgctgatgctatcacatgttacatgaagtactccgtatagatcctacagcngctgatgcactagttaaataggggggaacacttcgaaggggtng

SEQ ID NO: 6477 - DNA, 104 bp, Zea mays
  misc_feature: Incyte ID No: 700351869H1
gttgccgggttatcttgaagctgtaaaacatctatgcctgattgacactcctgtatgcgttggcataacccgtcatctggggtagtaatttgcaggatattttc

SEQ ID NO: 6478 - DNA, 279 bp, Zea mays
  misc_feature: Incyte ID No: 700351872H1
  unsure 45, 228, 262, 277: a, t, c, g, or other
ctgcatggttagggataacctagaagatatttcctagagtttcantagttgtttatggctgtattattagttgtattgaccttaatgcatgccttttggtttgttggcatttttagttcaaatctcaagtgccacactattatttggaacttgcagaagttattccctttgtatatacatatatgcatctacaggttttacatcatttcaaatttataaacgattttnttttcataccatttcaactatgaacatgtatgcnatatcgtttgaggtngg

SEQ ID NO: 6479 - DNA, 283 bp, Zea mays
  misc_feature: Incyte ID No: 700351873H1
  unsure 50, 57-59, 65-66, 68, 72, 86, 107, 154, 189-190, 197, 213, 222, 237, 240,: a, t, c, g, or other
ctcagaattaaattttgcctgcacacctaaacactgacaacatttagcanaaaggtnnnccatgnngnaggngtggtaagagctgnagttagcaaaattggcatccnctttagggtgtcaattctgtgctgctttgcaaattgttgaaactttngattttctgtttggcaatgctagtcagtgttcacnncttacanttagccaagaattttnatctaaatncagaaacttattaanganatccanttaaacnaacacaacatttngggaggcccngnngggg

SEQ ID NO: 6480 - DNA, 119 bp, Zea mays
  misc_feature: Incyte ID No: 700351874H1
  unsure 12-13, 19, 48-49, 58: a, t, c, g, or other
tcagagcagaanncactangccactgcgcgtctgaggctcagaccctnnctgtggttngctttgggtggccaatgggctggaaccctccatgatagttttggacacttggatcacctgg

SEQ ID NO: 6481 - DNA, 275 bp, Zea mays
  misc_feature: Incyte ID No: 700351876H1
  unsure 142-165: a, t, c, g, or other
gttcccttctatttctcgccccctactgattaaattttcttcgcacgaggaaaaaaatcaagtggcaagggcttgatctggtggccgacccatggtggaagggatggtagtggccgtgccgaatggggtgaaggcggatggnnnnnnnnnnnnnnnnnnnnnnnntaaggcagattctcctaaatccgttctggaggacgagaaaatttctgaatccaagaatgggaacgcctcttagccacggagccagttaagcaaggggacgagacctcggt

SEQ ID NO: 6482 - DNA, 268 bp, Zea mays
  misc_feature: Incyte ID No: 700351877H1
  unsure 44, 204, 231: a, t, c, g, or other
cgctccagccgcttcaccgcgccgccaccgccaccgcgaggatnccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaattcaagcggctctcatnactgacatcaagattgacatcaaacgngtccccaagaagacagccctgatcaaggggatggagg

SEQ ID NO: 6483 - DNA, 277 bp, Zea mays
  misc_feature: Incyte ID No: 700351879H1
  unsure 30: a, t, c, g, or other
ccactttcgatctcgtactcgatggcagcnacttggttggccgagcgcgcaccggtcagggaaaaactttggcttttgtcttgcccatattggagtctttggttaatggggcaaacaaggcatctagacggactgaacatggcaggaccccaagtgttctcgttctactaccaacaagagagctggccaatcaggtgcacgctgactttgagttttatggtgcaacatttgggctctctgcatgttgtgtgtatgggggatcaccttatcgttcctc

SEQ ID NO: 6484 - DNA, 277 bp, Zea mays
  misc_feature: Incyte ID No: 700351880H1
gaaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacatgtccttgcttaggtttggtgccctgtgggaatctgtttactgtgaggattctctactagtcttctcgactggaagatcaccaactctttacaaggaattaaggaaagagaagc

SEQ ID NO: 6485 - DNA, 281 bp, Zea mays
  misc_feature: Incyte ID No: 700351882H1
catcaacaccaccatctacccgctcacgtccctcccgctcctcatttactgtatcctgcctgccatctgcctgctcacggggaagttcatcatcccagagatcagcaacttcgctagtatctggttcatctctctcttcatctcgatcttcgccacgggtatcctggagatgaggtggagcggcgtgggcatcgacgagtggtggaggaacgagcagttctgggtcatcggaggcatctccgcccacctcttcgccgtcttccagggcctcctcaaggtgt

SEQ ID NO: 6486 - DNA, 283 bp, Zea mays
  misc_feature: Incyte ID No: 700351883H1
  unsure 9: a, t, c, g, or other
gtgcctgcntccctcatcgctcggctcaatcgctgatcagttctgcggccggcgacgtgtgctagctcacgacgacgacatgggctcggcggtgaagatcgggacgtggggcggcgacggcgggagcccctgcgacatcacggtggcgccgcggcggctggagagcatcaccatccgctggggcaaggtcctcgactggatcgccttctcctaccgggaccagagcgggaagctgcacaccgccggcccctggggcgggcaacggcaaaaggagagggcccgg

SEQ ID NO: 6487 - DNA, 275 bp, Zea mays
  misc_feature: Incyte ID No: 700351886H1
tctaaaccatctcagcatgagaatggtgaagctgatgagtgtgatggaacgcctacaagtgtagctgaaagttcctagttcggtatctgttggtgaagtagtttctcatggtaagaggatcaatgatattgcagaggacaacatgagagcacataacatattgtatgaagctgttggtgaaaatatttcaggtcctcattccatttgaatgaatattctagtggaaccatacaagctactggcaagccaaacgattgtcgacgtattgattcagc

SEQ ID NO: 6488 - DNA, 84 bp, Zea mays
  misc_feature: Incyte ID No: 700351888H1
  unsure 53, 58-59, 68, 70, 74, 76, 78-79, 81: a, t, c, g, or other
cacagtcacagatgacaaaaggatccaggaggttccagcaatgaaggttactnccctnntcttcacananacancnanntncat

SEQ ID NO: 6489 - DNA, 273 bp, Zea mays
  misc_feature: Incyte ID No: 700351889H1
  unsure 55-56, 106, 186, 265, 268: a, t, c, g, or other
caccgccatcatgatctgcctggtgctgaccatcttcgctaacctcttccccgcnncctgcaccggcgcacacgaacgcaccttcctggccgtgaagccggacggngtgcagcggcggctggtgggcgagattgtgcggcgcttcgagaggaagggcttcaagttggtggcgctgaagctggtgcnagcctccgaaattgcccgccgcgagattcgttctctggttccgcggcaaagaactcctctgtgggaaaaaagcgtgggnacnggctt

SEQ ID NO: 6490 - DNA, 278 bp, Zea mays
  misc_feature: Incyte ID No: 700351890H1
  unsure 5, 8, 24-25, 41, 51-52, 64-65, 73, 86, 115, 117-118, 120, 122, 125,: a, t, c, g, or other
ccatnacnctaatggcgtatctgnntgcaactaccggatcntctaatacanncattgaaacatnnctactccntgaccacatatcncataaacgctattgcttaccacacaacanannantncananntgtntgtctttgtatagtctgcagatgtggatcctaactcctgcgagaagtaactcacagtgacaaagcngcctttgcttttatcgagttgcaaatcaaagaaagggggacatnttggaaacaagccccccaagatctggccataaactg

SEQ ID NO: 6491 - DNA, 112 bp, Zea mays
  misc_feature: Incyte ID No: 700351892H1
  unsure 7, 23, 44, 48, 67, 70, 100, 105: a, t, c, g, or other
caactcnactcctcttggccgcngcatcacctcctcttcgccgntgcngccaccgcttccaccgggnagncagccagccatggatgaggagtacgacgtnatcgngcttggc

SEQ ID NO: 6492 - DNA, 316 bp, Zea mays
  misc_feature: Incyte ID No: 700351903H1
gaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagtt

SEQ ID NO: 6493 - DNA, 315 bp, Zea mays
  misc_feature: Incyte ID No: 700351904H1
  unsure 262: a, t, c, g, or other
caacaaggaacctagtccagaggttttgaacatcatcaataccctttgctcagatagtagaaacatcgtttttcttgtcagtggtagagacaaagatacgttaggaaagtggttctcctcatgtccaaaattggggattgcagctgaacatggttacatcttgaggtggtctagcaaagaagaatggcaaacatgcacccaggccatggactttggatggatgcaaatggcaaagccagtgatgagtttatatacagaagcnactgatggatcctacattgagagaaaagaaagtgccttggtgtggcaccatcc

SEQ ID NO: 6494 - DNA, 314 bp, Zea mays
  misc_feature: Incyte ID No: 700351905H1
  unsure 151: a, t, c, g, or other
ggtaaataaccttcactatagaaaacatgaaatataccactccattttgcaatgtgacctggtcctggtgtaacagattttataacataaatttcccttcaccttctctgttcgtacagaattatggtgcattctttgacctggtaggtgncggaattactggcccagtaaaactgagtggactaaacggtgcgctcgatctgtcttctgcagaatggacatatcagattggactcagaggagaagatttgcacctatatgatccttcagaagcttcaccagaatgggtctcagccaatgcttatccaatcaat

SEQ ID NO: 6495 - DNA, 311 bp, Zea mays
  misc_feature: Incyte ID No: 700351906H1
  unsure 21, 35, 48, 58, 69, 94, 107, 120, 126, 152, 155, 157, 164, 168, 177, 181,: a, t, c, g, or other
agctttaatttattaatgcanacagtacctaacanacccacaggtccnaaactaccanacctgcattanaaatttcggttggggcgacctcggngcagaacccaacntccgagcagtacntgctangacttcaccagtcaaagcgaactacnatncncaattgntccnataacttgnccancggnncaagttnccctagggataanagcgnaatcctatnctagagtccatntcancaatagggtttacgacctcgatgttggatcaggncatcccaatgntgcagccgctattaaaggtncgttgttcaa

SEQ ID NO: 6496 - DNA, 313 bp, Zea mays
  misc_feature: Incyte ID No: 700351907H1
gcaagccacgcgacgccacacacaggatagcagggacggcggcgcggaactagggttttgatccgccacgccggctaggctgcaccatcccgacgaagccatggagagggagctactggagacgttcgatgcggccaagaaggcggccgacgctacggcaggacagggcgactcgccggaggtggccgctgcctcgacgcgctgcaccggctgcgcgacatacgcgtcaacaccgacatcctcgtctccacgcaggttggcaaacgtcttcgacctcttactaagcaccctcactcgggcattcaggcagtcg

SEQ ID NO: 6497 - DNA, 329 bp, Zea mays
  misc_feature: Incyte ID No: 700351909H1
  unsure 103, 122, 125, 142-143, 149, 155, 158, 168-170, 172, 174, 183, 185, 187,: a, t, c, g, or other
gcggaaaggagtcggagggaaccgaaaaacttcagggtcctccgaatttccctaagggagcgggaggcgattgggttggaaagggaaggaaaaaggatttgcntccgcccgccaaaaccganggnggcaaattccggccgannaagganaagggnaanaaggccccannntnanggtcttccngngngggcttcaattttcctgttgnannattcaacngtnacttgaaccaanggattcaggcaattggccgctttgttgcaatganagcngntnactctgcngcnatcctggatattnnctgccgagtttctggatctgnctggnaa

SEQ ID NO: 6498 - DNA, 305 bp, Zea mays
  misc_feature: Incyte ID No: 700351910H1
  unsure 7, 64, 253: a, t, c, g, or other
cccgggngcccgggccgacggctcgactccactagtcgctggaaccctctgcaacaaagccgcntccacctgaccacctcccttgagctcttccccttcctcgtgggttgtgcgagccctctaccggcgcgcagtacaggggctgattgggtgatcaaacccgcaagatttgggtttgtgatttgggagcaggaggcggtggcaatatggaatataaggcgagatctactggaattcaggaacttcgtctaanagttccgtgatctgtacatatgaagtactcgagctacttaaacgacgaaccc

SEQ ID NO: 6499 - DNA, 312 bp, Zea mays
  misc_feature: Incyte ID No: 700351911H1
  unsure 10, 26, 29, 38, 41, 44, 62: a, t, c, g, or other
cccactggcntgtatctcactttcangtngacatcagncgnagnagcaggttcaatcatttntgacggcactgagagcgttatctcataaagacttccattgtggctcatatgcaacaagcgagcaggtggctgctgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcgtgacggttcaaca

SEQ ID NO: 6500 - DNA, 312 bp, Zea mays
  misc_feature: Incyte ID No: 700351912H1
  unsure 64, 70, 114, 124, 170, 266, 304: a, t, c, g, or other
tgaacagccccgctgtggattcccagagaagaatttatcagtgaatttggagaatttgacaggngggcanaggcaatggtgggaattcaaatcacagcacatggataaggttcngtttttcaanatgggcaaattctacgaactatttgagatggatgcacatgttggancaaaggatcttgatcttcagtacatgaagggtgaacagccccactgtggattcccagagaagaatttatcagtgaatttggagaagttagctgagnagggttatcgagttctggttgtcgagcaaactgaaacncctgacca

SEQ ID NO: 6501 - DNA, 311 bp, Zea mays
  misc_feature: Incyte ID No: 700351914H1
gcactgaacaaactcaagggtaaagaacttgaacttcttctggctatactccccgacaacaatggtccgttatatggtgacatcaaacgtatttgtgaaactgatttgggattgatatcacaatgttgcttaaccaagcatgtttttaagatcagcaaacagtacttggcaaatgtctcactgaaaattaatgttaagatgggaggaagaaacactgtgctcctggacgcaataagttggagcattcctttggtcagtgacatcccaactattatatttggtgcagatgtaacacaccctgaaaccgggga

SEQ ID NO: 6502 - DNA, 312 bp, Zea mays
  misc_feature: Incyte ID No: 700351915H1
  unsure 299, 310: a, t, c, g, or other
cgcaggaagaagcgacctcgcagatcacgagatgggcctacgtcagtggcagctgtcatccagcggtgggctgagcgcaacaagcatttggagtatgaggaatctgaggaggcaaagcgaccaagaaaagcacctgcaaagggttcaaagaagggctgtatgaagggaaaaggggggcctgacaatactcaatgtggataccgtggagtgaggcagcgtacttgggggaatgggttgctgaaataagagagccaaatcgtgtcgacagactctggctgggtaccttcccaaccgcggangatgcagctangg

SEQ ID NO: 6503 - DNA, 316 bp, Zea mays
  misc_feature: Incyte ID No: 700351916H1
  unsure 29, 41, 45, 139: a, t, c, g, or other
ctccttccaagccctcgtcaccaccagcntgctctcattcntgtncccacctggatctcgccctgcttgcgctcaacatgctccccacacactctcgttgcggcgtgtgcccgcccaacccgcacatcgctctcagtcncctccgcctcatcacaggtgatggcgtcgtcgtccccgcagtagcacaccgaggtcggctcgtcctcgaacctcgcgcaatttaggaatagcagcattatatccatgaacatggacgacatcatctgtaacatctacgacctcgagaccgtcaacgctgccgcggcaaggtcagccc

SEQ ID NO: 6504 - DNA, 312 bp, Zea mays
  misc_feature: Incyte ID No: 700351917H1
agaagcgtgctcggatagaacagatcagggtcatccttggcctttctgattctcaaaggactccagtgcctggagaatcactgagagatttctacaagaggacaaatatgtactggcaaatggctgcctatgagcacactcaacacactggaaaggagctccgcaaagacggttttgatcttgccgaaactcgattcaaggaactgaaaccgatacttgacgagctggctgtgctggaggccgagcagaaagctgaggaagaggccagtgcgtcgactagttccaagagggacaccaagaaacccaagcaga

SEQ ID NO: 6505 - DNA, 307 bp, Zea mays
  misc_feature: Incyte ID No: 700351918H1
  unsure 4, 18, 60, 265, 271, 273, 278-280: a, t, c, g, or other
gaanccaccgaattcccngcgattcctctcccctcgcctcctcgtctccccctaggggancgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgctcntctatngnagccnnngtaacggcagcggcgccgtcatggagc

SEQ ID NO: 6506 - DNA, 310 bp, Zea mays
  misc_feature: Incyte ID No: 700351920H1
ggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagat

SEQ ID NO: 6507 - DNA, 304 bp, Zea mays
  misc_feature: Incyte ID No: 700351922H1
  unsure 45, 48, 244: a, t, c, g, or other
catttctttcattctctccagccgaaacatctggccggtggcgtntcnctttgccgcacagccgccctatggcatgctgttgtccttcgctccctcgtttgtttttggttctagcatctacagtcgaccatcttttctcggttggtactttacgcatggccatctttgccttggtgttgcacctactctctgtttctattttctttcacttcttcaacaattttctagccaacgtgttctctgnacacgtccgcttgcaatggaggtgcgtgctgcatacatgcgcatgctccttttctctctg

SEQ ID NO: 6508 - DNA, 307 bp, Zea mays
  misc_feature: Incyte ID No: 700351924H1
tcgagcgcgaagaagccccaagcaagcgacactcttgtcatctccgcgccagatcacctgtttatgagctcgaaggagaagcccactcttggaggcacgcggattaagacccgcaagcggaacattgcagctcctttggaccctgcatcattctctgatgcaattgtccagatttatctggataatggtggagatctggaactcgtcgccaaaagtattgagtcttccgacctcaacttctcacgttacggtgacaccttttttgaggtggtttttgttggaggacgcactcagcctggcactgtaa

SEQ ID NO: 6509 - DNA, 299 bp, Zea mays
  misc_feature: Incyte ID No: 700351926H1
gttgcggccgaaccagagccccgtcccaactccaccacctctcttctctacggcgcgagcaagggcggcgcggccgggcgtcggcgggaaccgggcctcgtctccccatctctccgatcacttctgtctgtgaaaatggcggatgaactacgctcaacgtctgtgggtcagaagttccatgggcagtccgtgctgttgagcagaatctcttcctattccgccatgaacaaccctgtattcaacaatgcctattctgttacaatgtgccccagaggtcatatcatgggatgaatgcaatg

SEQ ID NO: 6510 - DNA, 309 bp, Zea mays
  misc_feature: Incyte ID No: 700351928H1
  unsure 2, 4, 17, 21, 25, 42, 45, 67, 84-85, 144, 150, 152, 157, 163-164, 166-167,: a, t, c, g, or other
angngccctacccagcntcanctgnagcctcacccccctggnccntggagctggtgctgtggacagngcttgggccctgctganncccagcggacacaagagcgtgctcagcagccaggtgtgtgtacatacggggtctctctncacgcngncaagncagcgnngnngcccganccgtggggcacgccaggccaggtcctcnctgatggacgnctgnngnncgcnanccccatctccaccgcatcatgtttacagggttcggnggcaggtttgttccagaacgccgcntcccacccagatcgcggtata

SEQ ID NO: 6511 - DNA, 303 bp, Zea mays
  misc_feature: Incyte ID No: 700351929H1
  unsure 2: a, t, c, g, or other
cntgttgattgggttaatgatgccattatagttggagacaagcttgtttcctgctcctcagacactacaataaaggtgtggaattgcttctctgatggtgcctgtaccaggactctccgccggcattctgattacgtgatttgtcttgctgctgctgagaataatagcaatattgtagcctctggtggtcttggtggtgaggttttcatttgggaccttgatgctgctcttgctcctgtagccaaatctgtggatgcaaaagaggatgaggttcctaatggaaactccgggcctgctttgaca

SEQ ID NO: 6512 - DNA, 307 bp, Zea mays
  misc_feature: Incyte ID No: 700351930H1
gatggctgggcgaccgccgccgtcctacgccaggtatcccgcgcttcaaggcggcaggcccttcgccggcgaagagcacccatcagattcccgagttgtttatcccagttatcttgcacccgagggctccgtagcatcttattatgcttcaagacctgttctacctgttggatcagatgttcttagaaacgatgtaatttctcaaccaagaacgcatggttatgatggtccagcaagagtgaccaatcctgctttggctggcctgactggactacctgctggagttacggcacgggggcctagtgct

SEQ ID NO: 6513 - DNA, 306 bp, Zea mays
  misc_feature: Incyte ID No: 700351931H1
  unsure 2, 38, 170, 180, 216, 231, 257, 271, 289: a, t, c, g, or other
gnaagaacaattatttgacataattatcaccataagangcctggaattacagaggatggacttgttgcagaggaggtgccgagcggtgtgaatttctctccacagaacgaaagtctgcctgccccaaagtcgacagcagcttcaacgatggcgggtagcatgcaaagcgncgcgcttganatgcatgttgaggcctcggtgctggggaaccctcantcgagcaactctacnacaacgtatgcgagatggagagctcnagtgagggtggctncccatcacgcgagagctnggctcggacggggagga

SEQ ID NO: 6514 - DNA, 307 bp, Zea mays
  misc_feature: Incyte ID No: 700351932H1
  unsure 46-47, 50-52, 108-109: a, t, c, g, or other
ctcctcgttctcccattctctctctcctctcccgagtccctccccnnatnnncccccctctccgcctccgtcgctagggctccattcccctgcgcatccgccgccgcnngatcccgcctcgcctccgccgcagcttcggcatcagaatcaccggattcggtggtgtttctcggctgcctcagcttccgccggcggaaggccccaggcggcgctccctgcagccctccggccttcatgagtcctccagaagccaaacatcgttgatattcgaaggcagctgagtatatggtattgtgggccattgtgc

SEQ ID NO: 6515 - DNA, 291 bp, Zea mays
  misc_feature: Incyte ID No: 700351933H1
  unsure 3, 6, 13, 15, 17-19, 33-35, 38, 41, 44, 46-47, 60, 71, 96, 117, 131, 148,: a, t, c, g, or other
tcnatnacatgtntngnnncttactctgtggcnnnccntgngcntnntaacagggatatnatgggaagcancactccagtggtcagatcgtcacantcttatggacgagcccatttnatatctggggaagntaaagtcctatgatggnctggtaagagtacgatacaggtgccatncnggacacgtgacatcactgaagactgcctggnaggggccgcgcgtgtgttcatgcctatacgntaaanatgntangncgatgganaatgctnanccttangtttaaaggtancc

SEQ ID NO: 6516 - DNA, 306 bp, Zea mays
  misc_feature: Incyte ID No: 700351934H1
  unsure 2, 6, 8-9, 12, 30, 34, 37, 48, 54, 64, 74, 84, 92, 107, 251, 255, 260: a, t, c, g, or other
gnactngnntanttgtgctggatgtcggcncctnacnaatgcagtcangtcatntaattagtcntcaggaacanagactaaaancagcaganaattgcgggttctanccagtcagaagatcacaccatggagactttctactagaggacttgaaagagaactgaggggccacaaaataaacttcaccttccattaagtgttcaagcatgtctgcaaattaggagggagttagaaacagtctttttcatccnttgngatgnagcctgaaattgtgccgtgttgccttatatgaatatgcagtatggg

SEQ ID NO: 6517 - DNA, 302 bp, Zea mays
  misc_feature: Incyte ID No: 700351935H1
  unsure 15, 37, 69: a, t, c, g, or other
ttctccttggttgcnttgcgcctccctcctgtctgcntgcgtgcaatcgacgcagaggcgcgggcgctngcaccaccacgaccacgacccgatggctttcatgcgctcccgctcaaatgcatcttctggcatgggagttgctcctaacattagggagacattcgtcgagcttcaaatgaagaaggcattccgatatgtaatcttcaaaatcgaagagaagcaaaagcaggtggttgtggagaagacaggggctactactgaaagctatgatgactttttggcctctctcccagagatgactg

SEQ ID NO: 6518 - DNA, 299 bp, Zea mays
  misc_feature: Incyte ID No: 700351938H1
  unsure 288: a, t, c, g, or other
tttgggatctggtatttctctgttcattgctaccaatatctgtgagaatatcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaangaatgctcgtg

SEQ ID NO: 6519 - DNA, 297 bp, Zea mays
  misc_feature: Incyte ID No: 700351942H1
gcgtgtcggcggcggtgttcagcaaggagaaattgctggagcacgtgatgagcgcggtgcccgagggcatcagtcgcgaggactggctacaggcgctgccgcgcgcgctcgtcgcaggattcgtcaagacagacattgacttccagcgcaagggtgagacgtcaggaacgacggcgacacttgttgtggttgatgggttcacggtcactgtggcgtcggtgggagattctaggtgcattctggatacacagggaggcgaggtctcattgctgactgtggatcaccggctagaggaga

SEQ ID NO: 6520 - DNA, 291 bp, Zea mays
  misc_feature: Incyte ID No: 700351951H1
  unsure 206, 221, 235, 274: a, t, c, g, or other
aaattattttgcagtatgatttcccaagtcaagaaatccgtaatacagttcgtcattgaggccatccaagcagaagctttcaatccaaaaacattgtttttgattggaagctacacaattggaaaagaaagattgtttatggaggttgctcgtttgcttcagaagaaagtatatgttggagctgcaaagctgcaaatactgaaacntttagagcttcctcnggagattatgcacnggtttacagccatgaagcagaaagtcacatacatgttgnccccatgtggactctag

SEQ ID NO: 6521 - DNA, 285 bp, Zea mays
  misc_feature: Incyte ID No: 700351953H1
ctacacttacagattcccttgtggcagctgctgggattattgcccaggaagttgctggtgatgttcgcatgactgatactcgtgcagatgaagccgagcgtggcatcacaatcaaatctactggtatctctctttattatgagatgactgatgagtcactgaagaactacaagggtgagagggatggtaaccaatacttgatcaaccttattgactcacccgggcacgtcgatttttcttcggaagtcacagctgctcttcgcatcaccgatggtgctctggttg

SEQ ID NO: 6522 - DNA, 281 bp, Zea mays
  misc_feature: Incyte ID No: 700351954H1
  unsure 26, 30, 32, 35, 39, 121: a, t, c, g, or other
cagaccatgtcttactactagatgtnatancnccnagcnaatagtcttggcatattcactcgaccttggttcactgctggaaccttcttgtgcaagaatgatcatcgtaaaattgttgccngcacaaataatcatcaggtccgcttatatgatactgcattgcaaagaagacctgccgtctctgttgattttagggagtcaccaatcaaggcagttgctgctgatccaaatgggcatgatgctatattggcccaggaacaggggacctgcttctttcgaaa

SEQ ID NO: 6523 - DNA, 281 bp, Zea mays
  misc_feature: Incyte ID No: 700351955H1
  unsure 46, 70: a, t, c, g, or other
aaagatcggaggagattcagcactgaataactacctctcgactcanccgtccagcaagaagagggcgcanttgctgtcgcaggccagtgtcatgaacgaggcgctgaaactgtatagggaggttagtgccggccaaggcaccgaagtttcctctagattctgggacctgctcctctgcttgtttcaaacgcctcacaaagaggttggtggtcttgttagctgcagtagtgacggcctgtggcatcggcgttctgagtggttcagaagcctggaagattaaa

SEQ ID NO: 6524 - DNA, 176 bp, Zea mays
  misc_feature: Incyte ID No: 700351957H1
cctactcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttc

SEQ ID NO: 6525 - DNA, 281 bp, Zea mays
  misc_feature: Incyte ID No: 700351958H1
  unsure 55-56, 61-62, 64, 67, 85, 87-88, 95, 184, 224: a, t, c, g, or other
gcaacttgcagaagaaatggaatcgtggaaggtcaaacaaaaggagaaggttgcnnacgcnncnccnatttatagtttcagagcnanncactgancagaagtcaaggaaaagagcagagaagacaaataagaagttgagtgttgccttagccaacactgaagcctcactgcaggcagtgacganagaacttgaaagagagaggaaatctaaaggaagagttganaagatctgcaacgggctcatcagaggcattgacgaggacaaagctgaggtggaggcc

SEQ ID NO: 6526 - DNA, 276 bp, Zea mays
  misc_feature: Incyte ID No: 700351959H1
  unsure 12, 58, 128, 245-246, 257: a, t, c, g, or other
gcagcgcgagtnctagcagcagcagcgattccttcgccataccgttcgctgcgctcgntcacttcggatcgaaaccccctagggttcgcatcgtcctcccgccaactcctatccctcccctctccctncgccgcgcgcgcggtggagctaccaaaccctaggacggcaaatccggtgcgatcgcccacggtggaggcctctcggccgccgagaggagccgctcggggctcggatcagggttccgnnatttcgggtgngcctttgtggtggacggtg

SEQ ID NO: 6527 - DNA, 275 bp, Zea mays
  misc_feature: Incyte ID No: 700351960H1
  unsure 36, 190-191, 219-220, 225, 229, 244, 249-250, 255, 269: a, t, c, g, or other
gccgcaggagccatctgcatctctcgcccacctccnctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttnntgaagttccgatggatcctcgtgatctnngtggncccntctatttcaatctgntctannataanttttgggggggtgncgtggg

SEQ ID NO: 6528 - DNA, 273 bp, Zea mays
  misc_feature: Incyte ID No: 700351961H1
  unsure 61, 195, 211, 221, 225-226, 244, 258, 264, 268, 270: a, t, c, g, or other
ggaggagctgacccggccgctccgggaggcggaggagttcctgacgacagtggaggcgcanttcaactccattactaacaccgggccaaccatgggagctttcatctcttcagctgcagataaaactggagtcgtcgatatgtccgacgatgaacaagaagaaggcagcggcatggaggcagaagcagcctgggnatcgatcttgctccgntgacaggggntaannaagcattcctcagaaaanacgggggtttttgncccccnaaananggg

SEQ ID NO: 6529 - DNA, 121 bp, Zea mays
  misc_feature: Incyte ID No: 700351962H1
  unsure 2, 18, 32, 39, 41, 55, 77-78, 81, 86, 100, 106-107: a, t, c, g, or other
cngaacacagcgcccgcncggacgcaaggggnacggggnanaagcgcggaatggnggacggcggcggcatcatggcnncgnggaanatccttcgcggtgnggcgtnnggccaccgcttcct

SEQ ID NO: 6530 - DNA, 279 bp, Zea mays
  misc_feature: Incyte ID No: 700351963H1
  unsure 270: a, t, c, g, or other
cccatctctccccctctccctctccctctcgtggccacgactgccgctgccgccctacgccaggtgtccaggtcatctccggcccattcgccggcgacgagcaccccactagatcgaccgagctatggacggcctgtggcatctgggggacgagctccgcgggcagcccaaggtggtggaggaccgccagtggtcgctcatgacgtccaagctggcagagatcaccaggtccaggggcgagaggacgaacgactcgactacgcaagatgnacgccgccc

SEQ ID NO: 6531 - DNA, 286 bp, Zea mays
  misc_feature: Incyte ID No: 700351965H1
  unsure 38, 77, 91-93, 101-102, 242, 251, 253, 269, 282: a, t, c, g, or other
acccaagtcatttgcaacgaaggagttgggtaccccangctgatggaggtagtccatgatggtcgcctgagcctgtncgatggtatgtggnnnccagaccnnagaaatgacccatacgcatgaactacctccatcagcatggggtacccaagtcatttgcaacgaaggagttagtttggttcctggcttctgccttgctagctctgcctgtcttcgtcatatacaggcttgtagtagagcanttctgcacnanaaagaacagaagcctngggcgataatggnacgg

SEQ ID NO: 6532 - DNA, 284 bp, Zea mays
  misc_feature: Incyte ID No: 700351966H1
cgaagactgccaagaaaggcgaggagaccacggtggccaagagcgagaagcgagggcaagaatctaagacgaatgccaagaagaaaatcttaggacgctcacggaagtgtgcccatgccgaacctgatggggagaaccgaaacggttgcagcagcactgatgcagacgagaactcacttgcagaaactgctgcctccgatcaggagaggaaggtggtgctgcaggaattgagaatcgaggtggatacatcacgagctgacattccaatgacaacaaggagattt

SEQ ID NO: 6533 - DNA, 280 bp, Zea mays
  misc_feature: Incyte ID No: 700351969H1
gctttacggatggggatggaacaagttcggacaagtcggagtcggcaacaacgacgaccacagctcccccggaacaagtcagttttccagaggatcagaaaatctcccaggttgcatgcggatggaggcatactctggccctctccgagaagaaaaatgtcttctcctgggggaggggcactagcggacagctcggcaacggtgaaatagtcgacaggaacacgcctgtgctgatcgatgccctgagctcagacggttctgcctgcaagaagctggagtc

SEQ ID NO: 6534 - DNA, 279 bp, Zea mays
  misc_feature: Incyte ID No: 700351970H1
  unsure 65, 235, 250, 255: a, t, c, g, or other
ctggcacccacgcgctcttcagatcagatcggcaaggccaatcccgagcagtggtgcgaaacctncgagcgctcgcgccggtgaccataacaaagaggaagccgcggtagcactggtagcggcagcagtaagggggagatgtcgtcggcgttcagcggcgatgagaccgcccctttcttcggcttccttggcgcctccgctgcgctcgtccttctcatgcatgggggcggcgtanggaacaacccaagantggcntcggcgtggctccatgggtataat

SEQ ID NO: 6535 - DNA, 278 bp, Zea mays
  misc_feature: Incyte ID No: 700351971H1
  unsure 133, 264: a, t, c, g, or other
caggggtataattattgctgcctttctaaaaacccaaaatgtagttctctattaacctgaaatgtacactagcccagaacagtttaatggtacttactgagctatagcatagctgcttagttgtttttgagantttttagtcaacacataatggaaacttctttcttctaaaagttgccagtgccacttttaagaagtgaatcactatatgtgatgtaaaagttattacactaaaccaggataaccttttgactcccctttggntcattgtgggataa

SEQ ID NO: 6536 - DNA, 272 bp, Zea mays
  misc_feature: Incyte ID No: 700351972H1
gtacaccacaagctttcgcttggagtcggacgatttgccttttagaaatgacatccggcctgtgcttcaggtcaaaagtagtgcacactcaatgatgggatttgccaatgatgctttcgtaggatgcgcacgtggaagcaagcaggtgaagggtttcatgtttgaaaaacccgttgatctgaaagtaggtgtgaaccatgttgtattgctgtcgtcaactatgggaatgaaggacagtggtggtgaacttgctgaagtaaagagtggcttca

SEQ ID NO: 6537 - DNA, 273 bp, Zea mays
  misc_feature: Incyte ID No: 700351973H1
  unsure 191, 197, 200, 224, 241-242, 244, 257, 265: a, t, c, g, or other
ggcatgtgcaggtgcagtctgttatatcggagttaagagagcgtttgcagtcgcactcaatgaagtcctatagggctagatttcaaaaaatatatgattcatgcatgtgtgcaaatgctcccatttttactggcattgagcaattgccacaattttcacatctacaagaattaattggtctaacagctacngattcngtngaacttggagatatcgtggacccnccggtaatcggaattgnnanttccaaccctccncctggganggctggac

SEQ ID NO: 6538 - DNA, 271 bp, Zea mays
  misc_feature: Incyte ID No: 700351975H1
attacagtagtgatttaaggccaactgcaaagcctctgtggaaacctagcattggcattcttgaactgggtatattgacagcacagggcctgttgccaatgaagaccaaggatgggcgtggcacaactgatgcatattgtgttgcaaagtatggacaaaaatgggtgcgtaccaggactataatcgatagtttcactcccaaatggaatgaacagtacacctgggaggtgtatgatccatgcactgtggtcacaattggtgtattcgacaa

SEQ ID NO: 6539 - DNA, 182 bp, Zea mays
  misc_feature: Incyte ID No: 700351977H1
  unsure 16, 50, 53: a, t, c, g, or other
cgtcgtctcgccagtngctacaccccaaaaacctcacgcgcgcgctgcgncanccctcgcgctcgcctcgtcggcacgccggcgagaggggcgcccatccccgtgcctatataaggacgccggattggaggtgcccgtcccttatccgcgcggccagatctacctctgttccacgcctccgt

SEQ ID NO: 6540 - DNA, 270 bp, Zea mays
  misc_feature: Incyte ID No: 700351978H1
  unsure 27, 242, 246, 252, 254: a, t, c, g, or other
acaactttgcaacgacttgtgtctgcngggtccccaagcatctgagggaggagcaagtgatagaatgtgtccattgcggctgcaggggttgtgccagcggtgactaatcttgtcatcatgttgttgggctcacgactcatcatcaccatcctgaccacattggatgtctcgtgagcatggatcggctacggtgattagcatgaatgtgttgtggtaactagtgggaagacaaaatttcctgncgtnggatgnanccaactgctatgtaaa

SEQ ID NO: 6541 - DNA, 273 bp, Zea mays
  misc_feature: Incyte ID No: 700351979H1
  unsure 54, 134, 148, 158-159, 168, 176, 206: a, t, c, g, or other
cgaaatcctccaataccccaccctacgaatcttccaacccctccgacgatgccntccgcgccggcgctcgtccccgcgtgcgacatgcaggagccgttgctggcggagtcgtccgaccgcttctccatgttccngatccggtacccgnaaatttgggnnttctaaaanaagggggnggggtcttttggactgccgaggaggtgganctctccgcggacgcgcgccactgggacgcggccctctcccccgacgagcgccattcatctcccacgt

SEQ ID NO: 6542 - DNA, 279 bp, Zea mays
  misc_feature: Incyte ID No: 700351980H1
  unsure 6, 60, 113, 152-154, 240, 250, 252, 262, 266: a, t, c, g, or other
gaaagnggcccccaatttctactgtaagcagcaatggcgctctcctgttgcttgctcgcnggcgcccgggcggcagccttccccttccttctcatcctccgctgccatccgcnggcgggaccaccgtctgctgaccttgtccgtggttccgnnnatcgctctctcagcgatgtcgccacggcctccgcgtgtgctgcgcctcctccacctcttcctcatctccgcggcgggaaactcccnaggagccgangnctaagattanttgncaaaattggaatt

SEQ ID NO: 6543 - DNA, 169 bp, Zea mays
  misc_feature: Incyte ID No: 700351982H1
  unsure 54, 72: a, t, c, g, or other
cgattcacagaggtttcagggggacccaaatcactgctggttttcaattttttntaacaatacatttttgtngtcagttccaacagcactgtccgtacttttaaaactggaatgacctccttcagatatcgtgcctcttagtgccaaacccacagtgagaccaaaagtg

SEQ ID NO: 6544 - DNA, 268 bp, Zea mays
  misc_feature: Incyte ID No: 700351984H1
  unsure 72, 74, 100, 226, 230, 239, 241, 246, 256: a, t, c, g, or other
gccgtctcgactgccccagtcctttctcagatccatgtctacccagaatctgctaactggcgcgtgcacgancnccgccccggccccgtccgaggcggangaaggggacaggacgcctttggctgacgctgcgaacgcggcggaagagctgtaccgcctccgtgacacctttttcccccgggacccttccgagaaagtcgccgcatccgcgcccggaagaagccgncctngggttctanangtttnccgtccgaanaaaagaattctc

SEQ ID NO: 6545 - DNA, 165 bp, Zea mays
  misc_feature: Incyte ID No: 700351987H1
gaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggac

SEQ ID NO: 6546 - DNA, 264 bp, Zea mays
  misc_feature: Incyte ID No: 700351988H1
  unsure 51, 93, 187, 191, 193: a, t, c, g, or other
ggtgcccacccagcgtgcaacctaggcgagaaccgcctccccctccgctcnttccagctcgcttctgtaatctgcatcagcctcgcccgccgncgtcgccgccatggggaggggaaagttcaaggggaagcccacaggccgccgcaacttctccacacccgaggagatcgctgctggtattcaggtnggcnangcactttaagaagaaggaggaagaggaagattaggaagagtagaagagaagaagtctgaggaagaatctgt

SEQ ID NO: 6547 - DNA, 169 bp, Zea mays
  misc_feature: Incyte ID No: 700351989H1
  unsure 143: a, t, c, g, or other
ggaggacagtagagtcgtcgaagcagctgtacgccggaaggcctaacccccgctatactatctgccttcctactcgcttccctccccgagtccccgtcctccttcagctgccttccgccgccgtgcagcacccgcgcagcctnccactccggacgtcgtctccctccct

SEQ ID NO: 6548 - DNA, 266 bp, Zea mays
  misc_feature: Incyte ID No: 700351990H1
  unsure 212-213, 215, 232, 238-239, 242, 246, 258, 261: a, t, c, g, or other
gatatctttaaggggatcaatttgaagcttctcgcctttgagaacatgttgaggacacatcccaagtggcaggggagagcagtgttagtgcagattgctaacccagcccgtggaaggggtaaagatctggaagccatccaggctgagattgaggagagctgccagcggatcaatggagactttggccagtcagggtatagccctgttgtttnnancggccgatatgtcaaangttttnnaanatcncctattataacntancgggg

SEQ ID NO: 6549 - DNA, 266 bp, Zea mays
  misc_feature: Incyte ID No: 700351993H1
  unsure 164, 254, 259: a, t, c, g, or other
ggcgctgggcagtgtggaggtcgttggagtcacttccgcgtcaccagctcctgtgcctgccagtcggtgcccctcccgctccagccatgctctccgccctcgcccggcctgtcagcgctgctctccgccgcagcttcagcacctcggcccaggctacctcgganctgaacagctgcctgactgcctgaaaggttgtgatgtggtagttattccggctggagtccccagaaagccaggcatgacccgggacgacntgttnaacaaag

SEQ ID NO: 6550 - DNA, 265 bp, Zea mays
  misc_feature: Incyte ID No: 700351994H1
agccttggtgaacattggcagtggctacagcttgggcaggggctggtggcagcgcaaaggagagtgagagggaactttaaggcaaaaacacttttctggttaatccatatggatacatccaaaagatgttatatatatgatccacccttcttaattcaattcaagctttcgccacaaagctctcttattctctaatactgataactttttggcggccccgaattggaggggtatggaggttgcagcatgctagccgtacccttgg

SEQ ID NO: 6551 - DNA, 270 bp, Zea mays
  misc_feature: Incyte ID No: 700351995H1
  unsure 2, 6, 10, 16, 31, 51, 55, 64-65, 73, 84, 91, 98, 102, 133, 137-139, 183,: a, t, c, g, or other
gntgantcgngatgtngctcctagaattggntatcagaaaccatcactgantgantctagattnnttcctgcncttcagggggngaacacnaaaatgncagntagtgacgcaaattcggcgatatacgtgacngatnnngctaaagacatgaagccaaaggtctgccctgctagaaagtttgnttntttagctggngaaatatcaggnacccttttagttggcccattaagttatgncgaaagcggntattagaccgnnccaagaattng

SEQ ID NO: 6552 - DNA, 270 bp, Zea mays
  misc_feature: Incyte ID No: 700351996H1
  unsure 131, 161, 165, 168, 180, 187, 205, 208, 223, 225, 230, 233: a, t, c, g, or other
attctagaatgaactcttctactcatcaatctggtgcatctcaatctgaccctgtaccaacaacaaataagaagcctggcagaccaaagtggctgaaaaggtaaaatccagaataatcttcttgccattgnggtacaatagttaaaaggggaaaaacttgncaanttncggggaattccncattccnttacaatcttcttaagcnatngtacacagtctcagngnatttnagnaggataattccttatcgtcttttggtaagttagcata

SEQ ID NO: 6553 - DNA, 300 bp, Zea mays
  misc_feature: Incyte ID No: 700352001H1
ctgaaaaatactaaagaccagaacgaacctgctgtgactattcggaatttgtcagattctgcttcgacatctgttggctatgcaattaagaaggatgggccttcagataacattgttaccggaactctgcctgtatgtaataaagcccaagaggatgctacatgtttacctctttcgtgccagaagcatgtgcctaaagatggacaagccgctgaaggagccaccaagaaaagtggcgcccccatcaggaattcatcgatctcaatgatgatgtgccaaatgatgacaattctgaggatc

SEQ ID NO: 6554 - DNA, 297 bp, Zea mays
  misc_feature: Incyte ID No: 700352002H1
  unsure 79, 267: a, t, c, g, or other
ctttggttcatcttcggcagcttctacaccaactttagcctctgtgtttgcaactggttcctccactgtgccatcagcngctgcagcttctgcagcatctgggtcgtcgttcccagctgtttctaccagtggttttagttttgcagttgcgccatcatcatcagcagctgcagctactgccactaccaccactgtcacaagtgcttctacatctgcaggcatgacaaccacggctctttgactggaacaacggggtttccaattttnatcttcaaacaactaccccagttctacctc

SEQ ID NO: 6555 - DNA, 295 bp, Zea mays
  misc_feature: Incyte ID No: 700352003H1
  unsure 33, 79, 261, 270: a, t, c, g, or other
cccttccccccaaacctagcacaaaacggggtncacaagccatggtcggggtccgggggggacagaaatggattgtctnggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccagtctaancgggcccantgcagggggcagcattgggggcatt

SEQ ID NO: 6556 - DNA, 299 bp, Zea mays
  misc_feature: Incyte ID No: 700352004H1
  unsure 11, 31, 68, 105, 174, 264: a, t, c, g, or other
gatcgcatggnctgcgccggcgccgcacggnaggtctcagcggtgctctaccactacccgtgcccggnacggcgcgtttcgcagcgctcgccgctcacctctatntttccggcgccgcccatccggtccgattcttccccaataccgtctacgaccccatcaggagtgattcanttccactggaagaaataaaagatgtttaccttcttgactttgtgggacctcctggttttgttgaagatatagcccctaaagtcgaaagantaacaatcctggaccatcataagaccgcttttgaa

SEQ ID NO: 6557 - DNA, 295 bp, Zea mays
  misc_feature: Incyte ID No: 700352005H1
  unsure 41: a, t, c, g, or other
ctcaggatggcttaagggtaaatcctgatggaactgctgtnaatcctcaagcttttcaacaacatgctcgaggtgattcacaacttatggcacagctccttcagaatgatcctcaactagcacaagctatccttggggatgacaccactgagctacagaatatcctgcggtcccgccaccaacaaagaacagaactaaaacgtaaacaagaagaagagcttgctttattgtatgctgatccttttgatgtggaagcccagaagaaattgaagctgcaatccggcagaaaggcata

SEQ ID NO: 6558 - DNA, 296 bp, Zea mays
  misc_feature: Incyte ID No: 700352007H1
ggcgattaacgatgaggggatgccaatttaccagaggcctttcatgaaggggaagctgtacatccatttcacggtggagttccccgactcgctggcaccagagcagtgcaaggctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagccagagagt

SEQ ID NO: 6559 - DNA, 297 bp, Zea mays
  misc_feature: Incyte ID No: 700352009H1
  unsure 76, 148: a, t, c, g, or other
ttccagcaaaccctaccagccttttgcaaactcagagagggacccgatggcacccaaggcggagaagaagccggcnccgaagaagcccgcagaggaggagcccgcggccccggcggagaaggcccccgctgggaagaagccgaagggnagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctcc

SEQ ID NO: 6560 - DNA, 294 bp, Zea mays
  misc_feature: Incyte ID No: 700352010H1
  unsure 16: a, t, c, g, or other
catggaaacggcagcnagccgcgagcttcccgtgcgcgcagtgtttgatgattgatcaccaatcctgcaacgctgcgcggccgatccgaggctgagccttgcaggcgtccatgttctcgtcagcaaggcaggtaagcatgctgtccctcaaggattgatttttttttttaatgagcaacgctgcatgctgtttgtccagcgtcttcttcacatgtctgaggtctgagcaattgcgggtggacatcgatggatgagcattgccgctgcaagggaagatcgtccggctcacacttg

SEQ ID NO: 6561 - DNA, 292 bp, Zea mays
  misc_feature: Incyte ID No: 700352011H1
cagcctaaaaaccctagcccccgaatcagatccgaccgcccgccggagcgcggaaccctgcccccggccgccatggagatgagcgatgcggagggctgttcttcttcgagatggcctgcaacaactccgaggtcgcgtacgagcagaaccccaacgacgccgacaacttgacgcgatggggcggaggctgctggagctatcgcaactgcgtaacggccccgacagcctcaagctcctccaagatgcggaagccaagctggaggaggcatgcaaattgatcccaacaagtctg

SEQ ID NO: 6562 - DNA, 292 bp, Zea mays
  misc_feature: Incyte ID No: 700352012H1
  unsure 10, 45, 151, 236, 290: a, t, c, g, or other
gccagtccanaggcaggtggtgaagcgtgaggagctcttcatcgncagcaagctgtggtgcacgtaccatgagaaggccctgggccaagcccgaggacccttctctcctggaggatcccaggatcaaggcgatcgcagccaagcacaatanaactacagcccaggtcctgatccggttccccatgcagaggaacttggtggtgatccccaagtctgtgacaccagaacgcattgcngagaactttaaggtctttgactttgaatgagcagccaggatatgaccaccttantc

SEQ ID NO: 6563 - DNA, 293 bp, Zea mays
  misc_feature: Incyte ID No: 700352013H1
cctatataggcagttcttgactagcaaagttactcaagtgaattacttgggcttccgtctgtatcgtgctttaccattcttgtatgaattgcggtgtgtacttgattggtcttgcacaaccacatctttaacaatgtatgattggctgaagatttatagtagtggtaaccctacaaatattgccaatcccattgttgatgtaagtgttaagattgatataaaggcacttggtgggagattaaacttgtttaagactactgcttgtgaaaaaataccttggaagtacttgaagg

SEQ ID NO: 6564 - DNA, 295 bp, Zea mays
  misc_feature: Incyte ID No: 700352014H1
  unsure 6, 21-25, 29, 66, 87, 109, 114, 123, 140, 160, 201: a, t, c, g, or other
gaccgngaacacgcccatgannnnnggcnttgggaaggctgcggatctggtgagtgcgaactgcgngacttatgagggcccacatgngagacattccgggattacctgnaaganaggctggangctgaatttggtaaganaatccatttgaacagccgcntccaggagtggagaggcttccgaacacctgcaacttttccntccaggggtcccagcttcgagggtacatggtccttacacagtgccagacactgctggccagcgtgggagcttcatgccactcggatgcatgagg

SEQ ID NO: 6565 - DNA, 297 bp, Zea mays
  misc_feature: Incyte ID No: 700352016H1
  unsure 35, 109: a, t, c, g, or other
ttctgggtgcaaaagcccagggttaggaaccgtangcatgctgcgccccaaggctttgacccaggtgctaagccaagccaacactggaggcgtccagagcaccctgctnctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggc

SEQ ID NO: 6566 - DNA, 293 bp, Zea mays
  misc_feature: Incyte ID No: 700352020H1
ctattctccaatatgatggtactaacatttaattctctctctagatccaaacggcccctttgtttttggtaacattacctcttttgagagattctgtgcaacagctgatgaacagggaaagctcgagagctccaccatctttgttttggcaacattaccctctccgagaaattctgtccaacagttgatgaacagtagaagcttgagagctcgccagtccccacctgcgaaggagaggcaaagaacgaaaggaggggcggtgcccatgtactggctagaggaggaatcaacga

SEQ ID NO: 6567 - DNA, 290 bp, Zea mays
  misc_feature: Incyte ID No: 700352026H1
  unsure 65, 123-153: a, t, c, g, or other
gacaaggggggcggtcacacacacgcggaccgcgcgagctagcgagcgagcgagatccccctctngcgctgctggatccgatctgacctgacttacctcgtcgccgccagccgtgagagagannnnnnnnnnnnnnnnnnnnnnnnnnnnnnncaccggtgtcggcgctcgccaagtacaagctcgtcttcctgggggaccagtccgtcggcaagaccagcatcatcacccgcttcatgtacgataagttcgacaacacttaccaggctacaattggtattgatttcctg

SEQ ID NO: 6568 - DNA, 289 bp, Zea mays
  misc_feature: Incyte ID No: 700352028H1
gtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctg

SEQ ID NO: 6569 - DNA, 291 bp, Zea mays
  misc_feature: Incyte ID No: 700352029H1
  unsure 96: a, t, c, g, or other
atggttcaaaacaggttaaacctgatagcagcagctctgacagtagctcagatgaggatgaaaaacctgctgctagcctaaagaagcctgttgttncctctgtgcaaaagaagacccaagaatctgatagctctgacagtgattctgatgaggatgaatcagaagatgatattcctgctaaagctcaagtagtagccaagaaaaaggaagagtccagtagcagttctgattctgatagtgattctgagtccgaggatgagaaacctgctgctaacctaaagaagcctccgg

SEQ ID NO: 6570 - DNA, 291 bp, Zea mays
  misc_feature: Incyte ID No: 700352033H1
  unsure 76, 242: a, t, c, g, or other
cacagggttcaactagtgacaagttggccagggatgagatagttgaggaaatggctggagctgatctgggaaatgntctccaaagtagagaatctcaaaactcaaacagaggtctttcagatacagatctaaacaccaattgtagctgtgcaacagaaaccacttcctattgtgatcagcatgccaaattcttgaaagaaaacagaaagagcaagcgtctttttgagcttcttgagatggantgctagaagattataacaaaaggttagctaagacatcaccaaaggaaag

SEQ ID NO: 6571 - DNA, 291 bp, Zea mays
  misc_feature: Incyte ID No: 700352034H1
  unsure 18-19, 21-22, 25: a, t, c, g, or other
cagttatttaggattganngnnacnaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttga

SEQ ID NO: 6572 - DNA, 287 bp, Zea mays
  misc_feature: Incyte ID No: 700352036H1
cgcgctatatgtctcgtctatctccaacgagctcaggatccctgtcaggtacctgcgagaggataagcctcacgggtcagctggagggctctacatctttagagattacatcatggaagacagcccgtcacacatagttctgcttaactgcgacgtctgttctagcttcccccttccagacatgctggaggcccataaaaaatatggaggaatgggtactttactagtcaacaaggtatctgcagagtcagctaaccagtttggcgagttggtagctgatcctgaaa

SEQ ID NO: 6573 - DNA, 287 bp, Zea mays
  misc_feature: Incyte ID No: 700352038H1
  unsure 30, 52, 70, 78, 115, 144, 162, 176-177, 237, 244, 275: a, t, c, g, or other
tagttggcgagttggagcaggtctgggtcncgccgcgtgagttatttcccanccaggcatctgagcagcnttggtctngacctcgacagaaatcgccatggacgcatcggcggangtggaccacctcgccgccgagaggtcggncgcgcgcttcgacgtctngcgatgaaggttgnntgggctggctcgcgacacgccgtcgaagtcggcgaccgcatggcccgactcgtcgcgtcncaccctntcttccgcaaggataacaggaccatgctctncaggaaggattt

SEQ ID NO: 6574 - DNA, 287 bp, Zea mays
  misc_feature: Incyte ID No: 700352039H1
attgacctttgcttcgccaatgaggatgaagctagagaggttatagggggaggtctggaatcagatccagaggaggcgcttgcgttcttgggcaagtattgcaaatgggctgtggtcacacttgcttcaaagggatgcatggcaaagcatggcaaacaggtcgttcaagtgccggccatcggggagagcaacgcggtggacacaactggagcgggcgacctgttcgcgagcgggttcctgttacgggctggtgaaggggttgccgctggaggagtgctgcatggttg

SEQ ID NO: 6575 - DNA, 286 bp, Zea mays
  misc_feature: Incyte ID No: 700352040H1
  unsure 154: a, t, c, g, or other
gcattataatcccttcagaacttcctgtctatcctgctagtaacttttactcggccccagatgctgctataccttctgtacatccaagcatgtctgtcttagggtcaacacgtcatgttcccgaacttgctgtacctgccgatgatcatggtcncctgcctatttaccaatctattcttccagttattcctacttatagtgccccaaaatgttcaggagaacttgagtttcgtgttttatgccctggtggaaaaattggcttggttattggaagaggtggggctac

SEQ ID NO: 6576 - DNA, 285 bp, Zea mays
  misc_feature: Incyte ID No: 700352042H1
gtgaagaaatgcaaacgatggtaaaagatctgctcaaggttgatgaaatggctcttcaagatgacactgatgacaagaaaccagctgtgaggtggttgaagcatgacaaacttgatgggatcaccttagttcatcaaaaggccgtgtcaaatgtggagtggcattacaagggagattacttcaccacagttgtgccaactggtgatacgagagctgtattgttgcatcagctcacgaaaaagcactcgcaccatcctttccgtaaaatgccaggccttcctgttg

SEQ ID NO: 6577 - DNA, 285 bp, Zea mays
  misc_feature: Incyte ID No: 700352043H1
  unsure 211: a, t, c, g, or other
acgcggtcgtctccatccgacccatcaatcatccaaaaactaaaccaaatcttccccatcgatcccaacttccagtcgatctcctcgctcggctgttgcctcccaaagccgtgccttacaacgagattcctcccctcctctctccaataaccctagcctcctccgccgccggcgacgaatccggcgttttgagtttctgttgccagcgtanccatgtccatgttcaataggatcttcgggaagcccaaggagcaggccaatccaatgccttggccactctggaca

SEQ ID NO: 6578 - DNA, 287 bp, Zea mays
  misc_feature: Incyte ID No: 700352045H1
  unsure 2, 16, 20-21, 63, 76, 78, 98, 123, 128, 158, 161, 170, 179, 182, 184, 216,: a, t, c, g, or other
cnacccgtcatctacnctannatctttgcaggcacactcatcacagcgctaagctcgcactgnattttttacctgngncggcctagaaataaacatgntagcttttattccagttctaaccanaaaantaaaccctcgttccacagaagctgccatcnagnatttcctgnacgcaagcnacngnatccataatccttctaatagctatcctcttcnacaatatactctccggacaatgaancataaccaatactaccaatcagtactcatcannataatcataatgg

SEQ ID NO: 6579 - DNA, 288 bp, Zea mays
  misc_feature: Incyte ID No: 700352047H1
  unsure 38-39, 41, 43-44, 47, 131: a, t, c, g, or other
cacatgcctatcatatagtaaaacccagcccatgaccnntnannggnggccctctcagccctcctaatgacctccggcctagccatgtgatttcacttccactccataacgctcctcatactaggcctacncaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagc

SEQ ID NO: 6580 - DNA, 287 bp, Zea mays
  misc_feature: Incyte ID No: 700352048H1
  unsure 83-84, 148, 286: a, t, c, g, or other
ccgccattcttctctatatgatgtagcctcaaaatcttctgcctctgtaactacaagaaacagatttggtcccgtcgattgtnnatggcatccatatatcttcttgcggacatgctgtgcatcaggaatgtcatgaccgatatttgtnctccttgaaacaaagatatgtccggagacttggttttgaaggtggtcatatagttgatcctgatttgggagaattgctttgtccagtatgtcgcagattgcaaattccattctcccagcatcacctgatttctcgggna

SEQ ID NO: 6581 - DNA, 196 bp, Zea mays
  misc_feature: Incyte ID No: 700352049H1
  unsure 2, 134, 168, 174, 180, 183, 185, 189: a, t, c, g, or other
cnccggcctccgcgcgcacggcggctacaagctgcccaagcactgcgacaacaacgaggccggctgggtcgtcgagcccgacggcaccacctaccgccagggaaggcaagcccatggaacgcatggatcccatngttgctcccgtgttcaccaaggccccatgttccncgtaancaacanaantncgcnggcatta

SEQ ID NO: 6582 - DNA, 286 bp, Zea mays
  misc_feature: Incyte ID No: 700352053H1
  unsure 284-285: a, t, c, g, or other
agcgattggcctccccacggcagccgaaatgagcggcggcgagaagatgttgctgtttgggtcctttacggaggacgagactaagttgtttcagggtcagcctctcaaaagtccaaataaaagcgtcaacaaagaatgtgaacggacggagatccagtttggcaccctgaacttttcagtgctgagtttagagaaggtatctacttcaagtgttgttcttcctgcaaaaatcagcaaacagcgagaccatgccatcgcaaaggagaatacatgcagtatgaaanna

SEQ ID NO: 6583 - DNA, 275 bp, Zea mays
  misc_feature: Incyte ID No: 700352054H1
  unsure 15, 101, 137, 183, 222, 254, 260: a, t, c, g, or other
agctcctggcctgcncggcttccggatccttggtctgcgctccagcgtgggcccggctgtgcaggcacgaggtgtccatcagagcgtggccaccgatggcncaagcagcacccagcctgccctgccaaaggccaganccgtggctcccaaacccagcagccggggcgagtatgtggtggccangctggatgacctcgtcaactggggcccgcaggagttctntgtggcccatgaccttcggcctggctgctgcnccgtgnagatgatgaaatggc

SEQ ID NO: 6584 - DNA, 276 bp, Zea mays
  misc_feature: Incyte ID No: 700352055H1
  unsure 207, 212, 217-218, 220-221, 227, 230, 236, 249, 258, 273: a, t, c, g, or other
ggacaaatgataggttgaggcgtgcagacagagaggacagcgttaggcgaactgtttatgtctctgaacttgatcatactgtgacagaggagagacttgctgatatctttgctacctgtgggcatgttgttgattgccgaatttgtggtgatccccactcagttctaggtttgcatttattgagttctctgatgaagagggtaaaanatctnctcannanngggggnaanatttgnggtccccccctgnaagattttncctcaaaggacgctnttt

SEQ ID NO: 6585 - DNA, 282 bp, Zea mays
  misc_feature: Incyte ID No: 700352056H1
  unsure 273, 280: a, t, c, g, or other
ctttctcctccagcaagtaaaccccgtttccacaacgtcacagacaccgccgtcatgccgaccgtaagcgtgaaatggcagaaggagctctttccaggcatagagattgacactagccagcctccgattgttttcaagactcagttgtacacactaactggtgtgccacctgaacgccaaaaaattatggtgaagggaggaatattgaaggacgatgcagattggtctatttgggagtgaaagatggccaaaagttgatgatgataggcaggntgatganat

SEQ ID NO: 6586 - DNA, 280 bp, Zea mays
  misc_feature: Incyte ID No: 700352058H1
gtactctactacctactaagtagttcagactttggagataacattccttgcacaatattatggttttggcttgttgtcctcttgacaactgttttttgtagatccataccaagaaaagaaactggttagagcataaaaggttaaataagttcgcctattgtagctacaaccggaaaatgcaaaacaggtttaaaaaaattaaagagcttggttccaagagaaggatgcatccactgttgctgaagattttgatggaaaaatggatgggttgtgccaataa

SEQ ID NO: 6587 - DNA, 285 bp, Zea mays
  misc_feature: Incyte ID No: 700352060H1
tgcatcctcatatgtgcttttgcaggaaggttttcgtagggggtgtagcctgggagacaactgaagaaacattcacaaagcattttcagaagtatggagctataactgattctgtgatcatgaaggacaagcatactaggatgcctcgtggatttggatttgttacattttccgatccgtctgtgcttgacagggttctagaggatgaacatgtcatagatggaaggacggttgaagtcaaaggactgttccaaagagctgtcgtcgaaagatggccctaagaca

SEQ ID NO: 6588 - DNA, 281 bp, Zea mays
  misc_feature: Incyte ID No: 700352061H1
  unsure 53, 123, 125, 182, 233, 243, 256, 260, 274: a, t, c, g, or other
ggcgcctgggaccctctgactacttcggggagattgcactgctgctgaaccgnccccgggcggccactgtcgtggcccgggggccccttcaagtgtgtgaagctggaccggccccgcttcgancntgtgctggggccctgctctgagatcctcaagaggaaattcagcgttacaacagcttnatctccctcaccgtctgagcacagctcccgccctgcagccccagctccccntgtggtggcngtgcctgctcgtntgtntcgggggccggganccgtgtt

SEQ ID NO: 6589 - DNA, 283 bp, Zea mays
  misc_feature: Incyte ID No: 700352062H1
  unsure 210, 257, 264, 267: a, t, c, g, or other
aatcctcgtacttgtgttggctggccctcgactagcgtgttgtagcacactagcgccacagtaatcgagagtgctctcccaggtcgaggtggtgtaggtgtttggcggagagccggggcgttagaatctgaggaggagaagatggtggtgctggtggtggccacgacgtcggacccggcgtccattgggcccgccgccgccttcctcgcnatgcccggatggtcccccggcccgcccatcgccgaggcatggaagantttaacnaangggaatgttcgattac

SEQ ID NO: 6590 - DNA, 284 bp, Zea mays
  misc_feature: Incyte ID No: 700352063H1
  unsure 101, 137, 172, 188, 229, 235, 241, 247, 261, 267, 270, 279: a, t, c, g, or other
ctttcggctggtgtagcattgagaggaggcgctgttccagttccagttccaggatgagcaaggaggatgtgctcaaggtgcagactttgatgctgagagtnaacatacactgtgacgggtgcgagaagaaggtcaanaagaccctccacaagatcgacggtgtctaccagancagcatcgacgcggancaggggaagtgacggtgtccggcttgctggatcgggacacnatcatngggaanctcaanaagcccgggcaagncggccnagntgtggggcncaacc

SEQ ID NO: 6591 - DNA, 286 bp, Zea mays
  misc_feature: Incyte ID No: 700352064H1
  unsure 191-192, 194, 233, 255, 264, 276, 281: a, t, c, g, or other
cccatctcggtctacaacaggacgacctccaaggttgatgagaccgtgcagcgtgccaaggtcgaaggaaacctccccgtgtttggtttccacgaccccgcgtccttcgtgagctccatccagaagccccgtgtcgtcatcatgctcgtcaaggctggggcgccggtggacaagaccattgccacgctcgnngngcaccttgatcagggggactgtatcgtcgatggtgggcnacgagtggtacgagaacacggnagaggaagnagaaggcgatgnatttntgggt

SEQ ID NO: 6592 - DNA, 285 bp, Zea mays
  misc_feature: Incyte ID No: 700352065H1
  unsure 262, 265: a, t, c, g, or other
gtgatgctgtccactgaggagactgagaagaagaaacatgcaacccacaaagatggcactgctaatggttcagcaaaagaaatacctgatgaaaagcctgccgtcactaagcctagtccctataaagaactgattggagacatcaaggctagcctgggaagtgtcccacacctacccagctccaaggctatgctggcctctcgacccttcttcccaggacgtgatgatgctctctcgaggctctctttgacggtgtgggcanggnttgcaaaggagtcgtgaaga

SEQ ID NO: 6593 - DNA, 277 bp, Zea mays
  misc_feature: Incyte ID No: 700352067H1
  unsure 106, 147, 162, 185, 194, 196, 219, 229, 238, 242, 262, 267: a, t, c, g, or other
caagggggcagttgtcggtgatggaggcgttcggcgggttcttcgtggacgagaaggcagcgcgggtggagaacatcttcctcgagttcctgaagcgattcaaggnctctgatggcgcgggggagccgtctacgaggcggagatggncgtgatgcggtcgcnggaatccactaccatgtacgtanactttgcgnangtcagcgttcaacgaagtctccnagaagccatntctgaagantacncagtttgaccgtactgaagnatgcntgcaagagtt

SEQ ID NO: 6594 - DNA, 283 bp, Zea mays
  misc_feature: Incyte ID No: 700352068H1
  unsure 251, 261: a, t, c, g, or other
acaagatatacaaggtatttgcaccaaatgaaaagattgaaaacatcaatgatcagtactggacactgcgtgcagaggaggttccagaggaggagaaaaatcttggccccttcgatcgtttgattcatgtatatcattttacaaaaggcactcaaaaccaaacgcaagttccagaactttggagaaccttttttatggttattcgtgaggatgagaccctatcttctatcaaagaacgtatacggaaaagnttagggttcnagatgaggatttctcaaagtgg

SEQ ID NO: 6595 - DNA, 274 bp, Zea mays
  misc_feature: Incyte ID No: 700352069H1
  unsure 38, 94, 225, 228, 260, 272: a, t, c, g, or other
atcaaggtggaatcaactgggttcactttgatgccaanctcttataactcttccagcaacaagaacaataaggatagtacataaattgtacccntttctcttgcctggtgttaattcatagcttgtagctggaagagttataagagcttgggcatcaaggtggaatcaactgggttcatttcctgatatttccaagttactggcgcaagtgaccttctgttgttnggntcttcagattatctcagtccttgcattgtggnatgtttccattncc

SEQ ID NO: 6596 - DNA, 275 bp, Zea mays
  misc_feature: Incyte ID No: 700352070H1
  unsure 43: a, t, c, g, or other
ctggccaagaccacatctttgctacatctaaccctgtaccganaaaccaaagaggagatcaattatttcatgtgtcctctcaaggagtgagtgcccattccagtgttctcatcaactacggtggttacaaccctcaaaattatcctcagcaaaatgcccgtcctcgtcatggacagccaattctccatcagcgatataatcaggcaattccagtccatgcggccatgggaagccatcacatgggcagctgcgtggctagtagttttggcagggcg

SEQ ID NO: 6597 - DNA, 277 bp, Zea mays
  misc_feature: Incyte ID No: 700352073H1
  unsure 8, 13, 26, 34, 263, 273: a, t, c, g, or other
cgactggntcgcngcgctcccaaggncgctcgtngcggggttcgtcaagaccgacaaggattttcaaactaaagctcattcctcggggacaaccgtgacacttgccataattgatggctccgttgtaactgttgcgtccgttggtgactcacgttgtgtccttgatgctgcgggatccagctactatttgtcggctgaccaccgctttgacgctaatgaagaggaggttggacgtgtaaccgaatgcggaggtgaattggaangctaaagttntcgg

SEQ ID NO: 6598 - DNA, 274 bp, Zea mays
  misc_feature: Incyte ID No: 700352075H1
  unsure 31, 97, 107, 120-121, 140, 172, 175, 189, 193, 198, 208, 236, 251, 266: a, t, c, g, or other
tagaaaataaacagagttgtctttgttgganactttttacgtgtcaataccctctgcaatgaaacttttggcatatgcactggattactggtcaaanggtcaactanaagcatgttctannacatgagggttacttggangcagctggtgcatttctggggctgcaaatttnagntaagctcagtctcnctcnctgcnacaatggccntccagaggactaaaaccggaggcttatnacggcattgtggtcnctgggaaccaagggntaaaaggt

SEQ ID NO: 6599 - DNA, 284 bp, Zea mays
  misc_feature: Incyte ID No: 700352076H1
  unsure 8, 37-38, 45-47, 49, 64, 79, 128, 133, 136, 140-141, 157, 165, 168, 178,: a, t, c, g, or other
aacgacgncgagaacaaccgttgtttccggctggtcnnccactgnnngntcctcagttcagtcncggattctcccttgngtctggagtggaatggaggttaatccgatcatggggtgatttcctcttntaaantgnattnncttcctcgtgtaggancagggcanccngagctcaaangtgcctgtggagtgtattacatcaagaatttgggttcganaagaatccacgagtccncccaataagtaccggccatgcttcaggcngtgacgggttttctggtccg

SEQ ID NO: 6600 - DNA, 283 bp, Zea mays
  misc_feature: Incyte ID No: 700352077H1
  unsure 21, 44: a, t, c, g, or other
ctctcctgcttcgcggctgtntctttcatcggccacccacggangcggagcatagcagtaagcaagcagcggagacgccggagagcggtgaagaagcatggagatggagcagctctgctcgctgctccgcgacctcgacgcgctcaagcagcatcccgacgatctcacttccaccatcgatcggatgcgggaacggctagtggcgatgatgaatccggcagccggtgccgcttctcgatccaagattaaggacatgagtgcagaagtggtggacaacaatccc

SEQ ID NO: 6601 - DNA, 279 bp, Zea mays
  misc_feature: Incyte ID No: 700352080H1
  unsure 200, 225, 233, 257, 264: a, t, c, g, or other
tctgacaatccgagtgctagaatgttctcgtaggactatgaagccaatgcaacaggacaacgctgaggactgcatccttcgcagcaattgctgaccttaaagacccgtatcgacatattcttgtcagcaagattggtgatatttgatatataattaaagtaagtctgacgtagctcattcgatggtaagtctagtctctnccataacatgaaagatccactaacnatcgattngatggacttgatcctcctctaagngtagagnatgcatgttttccca

SEQ ID NO: 6602 - DNA, 278 bp, Zea mays
  misc_feature: Incyte ID No: 700352082H1
  unsure 65: a, t, c, g, or other
gcgaatatccctctataaaactggtggtggagtggcaacttcaggatgacaaaaaccaaagtctnttctgctgggaaatcccagtacagatcgtttctcatctctaagtgcctcattgagttcggtgcatctggccaatgagtctgctgagactcttgacagcacctccagtctgctgcttcaacaacagtgacttgctctccaatggtatccagtgattcgttgaagaggaggtgtctgtagcagaaactgagctccgggtggctggttctcagtgg

SEQ ID NO: 6603 - DNA, 278 bp, Zea mays
  misc_feature: Incyte ID No: 700352083H1
  unsure 66, 75, 84, 274: a, t, c, g, or other
gcattctcacgctagctgttctcttcttgcctcatccatcgtgcatctatattctcggcgcgagtnacgtctttntcgtcgtcnggccggcgagcattttgcttctgtgatcgatcggcgcgcgcgacgtacggccatggtgatgatcgacgcagagctgcgtctgggtccgccggcagcagcaacagagacgtcatcaacgtcgtgcagccttcgttggcggcggcgaaacggccgtcgtcgtcggtggtggagagcgaggcgtccgggacgnagac

SEQ ID NO: 6604 - DNA, 274 bp, Zea mays
  misc_feature: Incyte ID No: 700352089H1
  unsure 252: a, t, c, g, or other
gagacctccagcgtggctgcatgcagcatgccatacttcagtggcatgtctctcacaattgacgatatggaatccctacctaatgaaaaatacgaagataaaatgagctcccaatatgattcatcagaaaggccagttttgtgcattggctgcggtctaaaatcagttctgtacataaaggatccatgaaattcccattctcggagattcaaactgcaacatcggatttttcaagtgaaaatttgctgggtnagggtggatttgggcatgtgta

SEQ ID NO: 6605 - DNA, 277 bp, Zea mays
  misc_feature: Incyte ID No: 700352090H1
  unsure 4, 99, 174, 176, 206, 208: a, t, c, g, or other
aganaagtctgcagaggaagaaaagagagcgaagggggttaaaccgcggaccgcggaggcggagcaaagcacacgccatccatccctggcccgtctgcngtcgcagtcccagtcgccctcctcttcgtctgtggtctccaccccgcgcacacgcacagttcgtcgacgcgagcnanggccagccgtccagggcacggaagtgggancncgcagcttctcgtcggcggggggtgggggctgagtcgcgggagtgatctagtggtttcgtggtctgcgg

SEQ ID NO: 6606 - DNA, 275 bp, Zea mays
  misc_feature: Incyte ID No: 700352091H1
atgaaatgcctgtctcaggccctgcataccttccaaaatgacatccacgtctaccccatctggctgtgcccgttcatcctgcccagccagccaggacttgtgcatcccaagggagatgaggctgaactctacgtggacatcggggcatatggggagccacgggtgaagcacttcgaggccaggtcctgcatgaggcagctggagaagtttgtgcggacgtgcacgggttccagatgttatacgccgattgctatatgaaccgggaggaatctggg

SEQ ID NO: 6607 - DNA, 270 bp, Zea mays
  misc_feature: Incyte ID No: 700352094H1
  unsure 247, 251-252, 256, 263-264, 268: a, t, c, g, or other
gaggcctcttgccacactccagaaatacgtgtgcggctgcttttaagaactatgtgtctggtcacttatttctctaaaattatctcattgcctggcaatcagtcttctctagtatacttgtcctagcacattgtgtacatgggaaatgtaaacaaatgtgaaggaggaccagaaaaattagttaatatttaaaaaactgtattgtgcattttggcttcacatgtttaactttttttaagaaaaaatngctnnaggngaaaaanntttntc

SEQ ID NO: 6608 - DNA, 274 bp, Zea mays
  misc_feature: Incyte ID No: 700352096H1
  unsure 261, 265, 269, 272: a, t, c, g, or other
gttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcattcccttccggagatatgtggggtgtnctcncacnganaa

SEQ ID NO: 6609 - DNA, 305 bp, Zea mays
  misc_feature: Incyte ID No: 700352101H1
  unsure 197, 226, 237, 286, 302: a, t, c, g, or other
cagggctctgaggctggcaatgcagacctgcgccattttgccctttatgccttcgctggacgtagtggcgaccgtagatggagccggaagaatgagaacatccagtcacagccatcagatgcttctgtgatgttaccacagcataattacaaactcgacgttcatgccctcaatagtcatcaacctggtcagttcgnatgtcgtgaattcagagaatcaatccttngcatcatgccncatcatgggataggagagaggtactacctacaattgcacatttaggaanataaaagggaacaatnagg

SEQ ID NO: 6610 - DNA, 308 bp, Zea mays
  misc_feature: Incyte ID No: 700352102H1
  unsure 8-9, 14, 31, 34, 38, 58, 68, 72, 77, 81, 96, 104, 123, 129-130, 155, 172,: a, t, c, g, or other
gccagtgnngcacncagaccagatctccgcnacntatnagtacgttcgtccagctaantgcactgcantgcnctgcncgcnatggccagcacggcnactgcagncggccaaggctgcaccggngcatgnncagcaggccaacggaacggcaacgncgagcagaagacgcgcnactccgaggtcggccacaagagcctgctnaagagcgacgacctgtaccatacatanggacacgancgtgtanccgcngnagcggagacatgaaagagngcgcgagatcaccgccaagcacccatggaatgatgacc

SEQ ID NO: 6611 - DNA, 310 bp, Zea mays
  misc_feature: Incyte ID No: 700352103H1
  unsure 62-63, 99, 124, 169, 171, 174-175, 270-271, 284, 287: a, t, c, g, or other
gcttcaggcttcaggcttcaggcggacacatccctcgcctcaatagctccgccgctggcganncagtgaagatagctccgaaggtggtatcccgtgtancgcatagattccggactctagtcgncgcggttctcgcaaggtccgcggatccgcgccccgctctggatcncngcnngatttgttgttctggaaggtatggcacgaaacttgaacgacaacaggaccagaaatacatagttatgattgtgctttttggtctctgttccttcnnctatctcttgggngtntggcagaaaagtggttctggaga

SEQ ID NO: 6612 - DNA, 308 bp, Zea mays
  misc_feature: Incyte ID No: 700352104H1
  unsure 134: a, t, c, g, or other
cacaacccagtcgctcaaaaccctagagctctcgcctgctcgcctccgccgccggagcgagctccccatcttcatccgtcaaccatggcgacccagatcagcaagaagaagaagttcgtcagcgacggtgtttnctacgccgagctcaatgagatgctgacgcgggagctggcggaggatggctactctggcgtggaggtgcgcgtcacgccgatgcgcacggagatcatcatccgcgccacggcacgcagaacgtgctcggcgagaagggccgcaggatcagggagcttacctccgtcgtccagaag

SEQ ID NO: 6613 - DNA, 301 bp, Zea mays
  misc_feature: Incyte ID No: 700352105H1
  unsure 74, 88, 130, 169, 173, 276: a, t, c, g, or other
actccaaacacttgcgccgccgctgcctcacaggtaaggccgccatggtctccggttcgggcgtgtgcgcgaanatccgtggtcgacncgcgccaccacatgctggggccgtctctcctcgatcatagcnaagaagctgctcaatgggcagaaggtggtcgtcgtccgntgcnaggagatctgcatgtcgggcggcctcgtccgtcagaagatgaagtactccgttctccgcaagcggatgaacaccaagccgtcccagggcccatccattccggncccgccaagatctgtggcgcaccat

SEQ ID NO: 6614 - DNA, 308 bp, Zea mays
  misc_feature: Incyte ID No: 700352106H1
  unsure 304: a, t, c, g, or other
gttaaagaaggattctgatgttttattgaccaacctgaaattcctagaggaaaacacaagaaagattcaaaagtctttcgaagatgaaagaacagctctcagaaaattaacagaggaacaccgagcagctaatgaaatacgtcaaaaggcctacattgaatggactgagcttagatcagagccctccaagaagaatgaatacttcttcaggtacagggatgaccggaatgcagcagaaattttcagagctaatggcgatataaatggacttaaatcacactgtaatagtcagttgagggagtcnggaa

SEQ ID NO: 6615 - DNA, 230 bp, Zea mays
  misc_feature: Incyte ID No: 700352108H1
attaaattaaattaaattaaattaaatggcaaccaaatacactagtgtatgtgtgcttacttgttttgttcggtgattcgtacggagtgcttacttaatattgtattgtattatacttggagtaggaagtatggtatccaaagatagcatctgttccaatacatcttgtaatcagactctgctctaactcgtaccaacatgctgagatgtcccaaggcatggcattgtgg

SEQ ID NO: 6616 - DNA, 304 bp, Zea mays
  misc_feature: Incyte ID No: 700352109H1
agccaggcagggtcacagcagactggaaacatcggccacacatgtgcaggctgggtgggagagactgttctgttccttgtgtaattgtgttgctgaaagactacctcgttcttgtctttgtgtgtcaccggggcaactgtgtgggggcggggatgggggcagggtggcagcgcgcccagtttggtatcaaaggtgctacatctctgtgaaggggtggggtgggaaggaatttctggtgctatagaatctgagatgctcccctagaccagcaaatgttccttttgttcaaagtatttttttattc

SEQ ID NO: 6617 - DNA, 307 bp, Zea mays
  misc_feature: Incyte ID No: 700352110H1
gggatagaagccagggaaaagataaggagcaggatggatccaaatccaaggaagccaaaagtttgctgaacactccaagcccatatggtaccaatcgccctcaacgtgagaggaaaacagtggagaggttggttgaggtgattgataaagagccaaacaagaatttcgtggttgagaagggacaggggactcctctgaaggatataccaagtgtggcacacagaatatcaaggaagaagccttctgatcttaaatttcttcacagtattctttttgggaggaaaggcaaggctgtcgattttaaagg

SEQ ID NO: 6618 - DNA, 305 bp, Zea mays
  misc_feature: Incyte ID No: 700352111H1
  unsure 304: a, t, c, g, or other
tgctcatttctgctgtgtggcttcttttctatggacaaccaccatatcattcactctgcatcgcacagttgtaaaacacaaaactgatgttgaagaatttggatctattttccacttatatgtgtggggaacttcactatctaccactgtattacgttcgataggaagtgactacggaagaccaggcacctggtgctggattcagcagggaagcatggcaaaggtcctacatttaataaccttttatcttccactttggggtgccatttgtacaatgggtttacatactatgaagtaaaccgcng

SEQ ID NO: 6619 - DNA, 307 bp, Zea mays
  misc_feature: Incyte ID No: 700352112H1
  unsure 281-282, 292-293: a, t, c, g, or other
aggcaacatccgaggcgtggctgtcaaagcatatagatgactctgtaggatatagttcaaatggttcaaatgttgttatatgggacacactgtctccaccagctacatctcaaacatctatcatgtgtcatgaaggaggagctcggtctatttctgtgtttgatagtgatagaggctatgggtctatctcaccgcttgttgtaactggtgggaaaaatggagatatagctttgcatgattgccgcttcctttctactggaaagtccaagcatcatagagtnnccactgaccnnggttccggggctct

SEQ ID NO: 6620 - DNA, 306 bp, Zea mays
  misc_feature: Incyte ID No: 700352114H1
  unsure 272: a, t, c, g, or other
ctgggaatggtaaaaccgctagttgacattctttggtttacatggagaatgaagcttttatctggacgaagaggagttgctatactgtatgcttacatgctactgggtttgggctttcttagagctatatcccctgacttcggtcatctctcaggccaagaacaagaacttgaaggaacattcaggttcatgcactcgagactgcggacacatgctgaatcaattgctttctttggtggtggttcaagagaaaaagcgatggttgaggctanattcgtcaagttaattaaccatcaaagatctttg

SEQ ID NO: 6621 - DNA, 307 bp, Zea mays
  misc_feature: Incyte ID No: 700352116H1
  unsure 197: a, t, c, g, or other
cacgcccttctggctcacgctctgcctcggtgtcgtcgtcccattcaagctctacgagaggttcacggagctggagtacctgatccttggcttggtgtccaccgtcccggcgttcgtcattcccctattcctcgtagggaaggcagatagtgttagaaatttcaaagatcgatattgggtcaaggctaatatttggnttatatttttagctatgttggtaactacttctggacacattacttcttcacagttcttggcgcgtcatatacttttccatcaggaggatgaataatgtacctcatacgac

SEQ ID NO: 6622 - DNA, 306 bp, Zea mays
  misc_feature: Incyte ID No: 700352118H1
  unsure 25, 39, 81, 146, 265, 275, 280, 291, 297-298, 300, 302, 305: a, t, c, g, or other
tggaaggagcaggaagatgccggcngggcacgggctgcngtcgcggacccgcgacctgttcgcgcggcccttccgcaaganggggtacatcccgctcaccacgtacctgcgcacctacaagatcggcgactacgtcgacgtcaagnttaacggcgccgtgcacaagggcatgccgcacaagttctaccacggccgcaccgggagcgtctggaacgtcaccaagcgcgccattggcgtcgagatcaacaagcaggttaacggtcgnatcatcaggnagcgnatccatgtccngtgganntntnccnc

SEQ ID NO: 6623 - DNA, 299 bp, Zea mays
  misc_feature: Incyte ID No: 700352120H1
  unsure 102, 134, 269: a, t, c, g, or other
cgaaaaggtgatcctgcaatttgggaaggtggctaaggacatgttcaccatggactaccgttacccactgtcagccttccaggccttcgcgatctgcctgancagcttcgacaccaagctggcctgcgaatgangccaccagtcatggctcaaagtcaaggacgatctgtctgtttcacgaagacggtggccccaaattttgctgggccaccattctgttgtatgttgttgatgccttcttaacttacctaggaagctgcgtttagacntttgcacctgatctacagtgctgtgtgttt

SEQ ID NO: 6624 - DNA, 303 bp, Zea mays
  misc_feature: Incyte ID No: 700352121H1
  unsure 43, 45, 247, 255, 257, 261, 264, 267, 270, 273, 284, 295-296: a, t, c, g, or other
ctacgtttcagcaatcggtagcacaaattctccccagctacanangccgactatatggtctgcttgacgagtcgtccagggaggcacggcgtgatgaatggcgaccttgattccaacagcatatagtaactatatatatagttatgttgtggcattgtatgatgcaagtgcgagaaactgctttgtggctgtgtgggtgacatatacaattataataaaatgtcgatttggcttgtcaaaaaaaaanaaaaaaananaagngcnccnaanaanactcaacgacncctgaagatcnnaggtggg

SEQ ID NO: 6625 - DNA, 303 bp, Zea mays
  misc_feature: Incyte ID No: 700352122H1
actcccgccgcctgtagaggcctcgtcctctcgcccaccggcgaaaaaccgttcccctctgccgtttccgggtctcttagtgcaagcaaggaggccgttccacgctcctccagcgagctccgttctgaagcggcaagaaagatgattaatcttttcaaaataaagggtcaaaagaaagatgaggcagcaagtgctactggaaaggcccctgttaagaaacagtctgctggggagctccgtcttcataaagatattagtgagctcaacctgccgaagaccacatcaatttcttttcccaatggc

SEQ ID NO: 6626 - DNA, 299 bp, Zea mays
  misc_feature: Incyte ID No: 700352123H1
atccacaactgcctcagttatcaaagagttacatgagaatcaagtgagtctccatttagtcctgtaatttcatttgactgttatcatgctcggaagctcttgttcatagtttagagttgtccaattctttgcccaatcagtctgctccaggctgttcaatgtacatggccgtagtaatgttaccatctccgcatctcctgattagtttgagctctggtatattgttcaacgtaccggggcgcaaatatgttatgaattctttggaccatcttaacttgttatgtgtgcatgaggttttt

SEQ ID NO: 6627 - DNA, 299 bp, Zea mays
  misc_feature: Incyte ID No: 700352124H1
taagatctaaaaccagccatccgtcttctgggaagaagaggtatagtctcccgatcctagttctgcctctccagttgcatccttcgtcactcactctccctacatcctgtcacgagactggtgttcagacctgagagacctttactcccatggttcagatgtctttgcagaggagcatagccgtatatcctcgttgctccttatctgattcgttccatcgtgtgggtggttcacgaagaagatgggcctcttgtaggtcccagtcatcagttttgcttatatgcaagaccatccccaat

SEQ ID NO: 6628 - DNA, 301 bp, Zea mays
  misc_feature: Incyte ID No: 700352125H1
gaagatctccagggaaatctctgacgccagtgggaagacgatcccagtggaagagatcctaacgatcgacgtgaagccggggtggaagaagggcaccaagatcacgttcccggagaagggcaacgagacgcccaacacgatcccggcggacctcgtcttcatcatcgacgagaagccgcacccggtgttcacccgcgacggcaacgacctggtggtgacccagaagatcccgctggcggaggccctgacggggtacaccgcgcacgtgacgacgctggacgggcgcactgacggtgcccat

SEQ ID NO: 6629 - DNA, 301 bp, Zea mays
  misc_feature: Incyte ID No: 700352126H1
attgcatagtaacgagtcttgactggtctaaaaagttccctttgcatcagtcaccactttggaattttcaaaataggcagggcagtaattgcagttacatatataagaccaactacatcgactccaccctgcctgctgaggccgtgtttgcagcggaagtggagaagctcaaggcggatcagttcaagcccgcggagcaggtgacgttggagccctacgagcgtgaccatgcatgtgttgtgggtgggtacagggtgcccaagaagcagaaggccacctcttaggatcggaatccgtgctc

SEQ ID NO: 6630 - DNA, 303 bp, Zea mays
  misc_feature: Incyte ID No: 700352129H1
  unsure 67-68, 70, 77, 89: a, t, c, g, or other
ggcctacacgccgccgcttgtgccgccgccatgtccctagtgatccccgagaagtttcagcacatcnngngagtacncaacaccaacancgatgggcggcggaaaatagccttcgctatcactgccattaagggtgtggggcggagatacgctcatgtggtgttgaggaaagcagacattgacctcaccaagagggctggggagctcacggaggacgaggtggagcgtgtgatcaccatcatgcagaacccacgacaatacaagatccctgactggttcttgaacagacagaaggacgtgaag

SEQ ID NO: 6631 - DNA, 303 bp, Zea mays
  misc_feature: Incyte ID No: 700352132H1
actgtctgtccatcaaacttgacatatctggctcagcatccattgtttgagcagataaaagagctcagtgaagacataattgttcccgaatactgttacgctggtggaggtgaactccaatcacttaatgcttggtttggtccagagggtacagtgacaccattgcaccatgatccgcatcacaacatcttagctcaggtattgggcaggaagtatattagactctatcctgctttcatagctgaggacttgtatccacacacagagactatgttaagcataccatcagtagatgttgacaat

SEQ ID NO: 6632 - DNA, 295 bp, Zea mays
  misc_feature: Incyte ID No: 700352133H1
  unsure 14, 21, 133-134, 175, 195, 217, 220, 248, 272, 290-291: a, t, c, g, or other
ctggggtgtctgcnctctgtnggccctgcttcctgccaggacgtggcctcttccgatccttttctctcagacactggaggtctcttctgccattgtgctggtcccatcccaagaattgtaggacagagaccannctgggtcggcggacacaaagtccatccaggacccaggccgnagagggagcaggaagagatnctgatagtttgatctagaaccnagnagctactggctcaattcagtttggcgtnaaatagcgattttcgagtttctcnaaaaaccgtgttgggttnnagtg

SEQ ID NO: 6633 - DNA, 289 bp, Zea mays
  misc_feature: Incyte ID No: 700352135H1
  unsure 33, 36, 50, 57, 60, 64, 93, 95, 100, 109, 144, 151-152, 159-160, 162, 165,: a, t, c, g, or other
tcgggcctgcccgctgcgtttccggcatatgtntgntgcggcgggcgtcngcccttncgnggcntcccctggtcacggcgggcgcgccgggcncngcccngcttgcgantcgggcggcctcgacgccgtgtttgtggtctggcncggcgtnntctgcgnngnccngggccccggttctctggttcgggggcttggggggtggtcncccgtccggctcgggtcntgtcgcgcntngnggcgcngtcccggtcgggttgtttgggntgccgccngctngggnggtagctcc

SEQ ID NO: 6634 - DNA, 296 bp, Zea mays
  misc_feature: Incyte ID No: 700352137H1
tcgccccccacggacctgaaccgagaaccgttaccgccgccggagaagcgccgctcgctcaggaggacagccatggcgccggagccggaggatgatattatgaacgagaagaatccccgcccgctcgacgaggatgacatcgcgctcctcaaaacctatggactggggccgtattcgactagcattaagaaggtcgagaaggagatcaaggaaatggccaagaaaatcaacgacctctgtgggataaaggagtctgatacagggctggctccacctagccagtgggatttggtttc

SEQ ID NO: 6635 - DNA, 292 bp, Zea mays
  misc_feature: Incyte ID No: 700352138H1
gtcttactactttgaccgcgatgatgtggctttgaagaactctgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccatgacaaaatgacccccatttgtgtgacttcatgagaca

SEQ ID NO: 6636 - DNA, 296 bp, Zea mays
  misc_feature: Incyte ID No: 700352141H1
  unsure 153-154, 269, 272, 278, 290: a, t, c, g, or other
ccataatcatacaaagcccccgcaccaataggatcctcccgaatcaaccctgacccctctccttcataaattattcagcttcctacactattaaagtttaccacaaccaccaccccatcatactctttcacccacagcaccaatcctacctcnntcgctaaccccactaaaacactcaccaagacctcaacccctgacccccatgcctcaggatactcctcaatagccatcgctgtagtatatccaaagacaaccatcattccccctanatnaattanaaaaatattaancccata

SEQ ID NO: 6637 - DNA, 295 bp, Zea mays
  misc_feature: Incyte ID No: 700352142H1
ggaaacgacttaggagctggaacgacatctaggagctttacgacagaagagatctctaaacattccacaaggaaggactgttggatcattatcaaggacaaggtctatgatgtcactccttatgtagaggaacatccaggcggagatgccattctaaataatgctgggggtgattccacggagggcttttttgggccacagcatggcactagggtcttcgatatcatcgaggatttctgcatcggtcagttgaaggcttcatgatgatgacaggatagtttgtattgaatttatt

SEQ ID NO: 6638 - DNA, 294 bp, Zea mays
  misc_feature: Incyte ID No: 700352143H1
gtgcccgcatctcacaagcattgtgagacgaaaggtcctaagtctcacgctagtaaacagaaggagtcccttcaggatgaacccagaaccccagcaccagctaacaagaaggctgctgtcagctccactgttgatggatctgattttggcaccaaagggtgtggtgctggtgtgatccatggctcgaaggttggtgagctgtcaagatcaaatgagaagggtgaatgctcccaaagctctaagagtagcattggtgattatagcaccagcaccagcatcatgaggacagttatg

SEQ ID NO: 6639 - DNA, 143 bp, Zea mays
  misc_feature: Incyte ID No: 700352150H1
aaacggaggagggcactcggcgaggcaggtggcgattctgcgattctcctgtacaccttccgtcgtctccatccccttccatttccggcgagggtcaaagcaggcctcttgctcttgggggtggctttgagagagggagagaa

SEQ ID NO: 6640 - DNA, 295 bp, Zea mays
  misc_feature: Incyte ID No: 700352151H1
gtttggcattccttgcgcttagttgtgttggatatgccattccttttataatgtgtgcagcaatatgctgctgctttccatgcttgatttctgttttgcgtcttcaagaagatttgggtcaaaatagaggagctactcaagagctaatagatgcattgccaacctacaaattcaaaccaaaacgtgtcaaaaactgggggattgaccagcttcaagctcagagcatcttgatgagggtggcatcttggcccaggaactaagaaggaaagagttgtttcagctgaagagctgtgtc

SEQ ID NO: 6641 - DNA, 193 bp, Zea mays
  misc_feature: Incyte ID No: 700352152H1
  unsure 153: a, t, c, g, or other
gcttctgactgaaggttccattgactatgatatcatcaacaacgtaccgacacctcgtctttcaagaggaaatacagatcggtttcttgctgatccaaacaggtctcctaaaaccaagctcggggccaacatgccttcacgagctgaactctncgcccgcaagagcgactgcgaaccgcagctgatcggagag

SEQ ID NO: 6642 - DNA, 239 bp, Zea mays
  misc_feature: Incyte ID No: 700352153H1
  unsure 67, 105, 107, 118, 136, 156, 194, 225, 232: a, t, c, g, or other
tgtggtaactcaagaactgttcttatgcatgcagcagccataagcattgctactagcgtctcctgcncgtgctgtgtcgtttccagggtttcatgcggggcgaananctggtctctgncgcctgaacgccgccggnatctgcgaggcctccccganctgcgtgcgtcgtcggataaggcagccggcacggaatnccggttccgcttgctccgtacccagctcctncggcganattcacg

SEQ ID NO: 6643 - DNA, 294 bp, Zea mays
  misc_feature: Incyte ID No: 700352155H1
  unsure 184, 190: a, t, c, g, or other
gcaagacggatctgcaagcgcagtccaaggagcttaaatcggagctctccctcctacgcgtcgccaaggtcaccggcggggctcccaacaagctctccaaaatcaagattgtgcgcacctccatcgctcgcgtgctcaccgttatctcgcagaagcagaagttcggcgctgcgtgaggcgtacnagaagnagaagcttctcccgctcgatcttcggcccaagaagacccgcgccattcgcaggcgctcaccaagcaccagctctccttgaagaccgagaggaaaagaagcgtga

SEQ ID NO: 6644 - DNA, 290 bp, Zea mays
  misc_feature: Incyte ID No: 700352156H1
  unsure 171: a, t, c, g, or other
ctcagtaggatgcaacaagaacatgcccaaccttcaatggttggtgcgaaggggtgtgagagatgcagggactggcaggagcactactactgggagcatatggatgtgagcaagatccgcttcttcaggcgcatgacaggagactttgctcatcgcattagcgtgccgganaagttcgcaaagaacttcaaggggcagatcaccgaagagtttcacctgaaatcacctagcggcgctgagactggcactcggtgtagagaagcatggcgacgaactattccctcgcgtca

SEQ ID NO: 6645 - DNA, 289 bp, Zea mays
  misc_feature: Incyte ID No: 700352157H1
gctgaacagcaatgactttggtggtgaggggttcaatacttcaaggggtgctgcatatcccggaagacatgataatatcgaagacgatcggaaacattttccagcaccagcccttctggatggtcaaggcttgcaaagggaccctagacattttgagagagctttaggtagacctgatggtttccttgattcagtacctggaaggcctccttttccaaaccatagaagtgtaggtttgcatgagggttttccaagaaaacaaaacacaactgccagtcaccctgacgtc

SEQ ID NO: 6646 - DNA, 288 bp, Zea mays
  misc_feature: Incyte ID No: 700352158H1
caattccggtattttcgaatcctatctcaagtagcttatctagatgatattgtgaacagttgggcatacacctaccaaagaacacatgttgatacccggacaggaacatcccgcatgaagagttcaagtgccaaagaatgtcaaaggaccaagtatgctgcaggaaccaatgtacaagttgctccctgttgccatccctgctgaggttcaagacattccagcccaacacactcaggatcatgaagttgttcctggtcctactgaggtgcaaggcatccggttaagcat

SEQ ID NO: 6647 - DNA, 290 bp, Zea mays
  misc_feature: Incyte ID No: 700352159H1
  unsure 14, 35, 65, 129, 131-157, 171, 219, 234, 237-238, 242, 262: a, t, c, g, or other
gacccaccagatcngcccccgttttctcgcctcgnggtactcgcccctcgcacccgcccctcagntcccatgggctctcgccgtcgctgacactggggcccaacgctctcccccgcgtccgcgcccgcntnnnnnnnnnnnnnnnnnnnnnnnnnnngttgcctccactgnctctagccgaccgcccccgcccaccgacatcggaagccctagctgctncaggaatgccctgcnggnncgcngctctccgctcgaaggtctncggtttcttggatgcaacggctgtccga

SEQ ID NO: 6648 - DNA, 289 bp, Zea mays
  misc_feature: Incyte ID No: 700352160H1
ctaagattgataggttagatgaagcttacatgctttttgaggaagcaaaatcaaaaggaatagaattgaatgttattgtgtatagctctctcatcgatgggtttggaaaggttggtaggatagatgaagctatttgatattagaagagatgatgaagaagggtttggcaccaaatgtttacacatggaacagcctatggatgcttagtgaaagctgaagaaatcaatgaagcattattgtttccagtcaatgaaggaaatgaaatgttccccaaacacttacacatata

SEQ ID NO: 6649 - DNA, 289 bp, Zea mays
  misc_feature: Incyte ID No: 700352161H1
tgaaggagttaattgtttttccttaagcaacacgaatgtcactagatcttggaaggacataagatgtcctgtggttgagtgtgataaaattattactgaaagaagtggagaggaacatgaacacagacttggctccaagagattgggacagggattcgctgaaaaagcctcttataatggtgaagtgttgtatgaaactaaaaggagggagttgatcatacaaaaagagtttcagagcccagggaattctaaggagaagtggggagcttctgaggcgtatgtcttactc

SEQ ID NO: 6650 - DNA, 294 bp, Zea mays
  misc_feature: Incyte ID No: 700352162H1
gcagaggccatggagatggtgaacctgaagctctacctggagaaccggtgcatcatcgcggagaacgagaggctgcgggagagggccagcgcgctccgccgcgagaacctcgcgctgctccaggacctgtccaagacgccggccgtgccagaggcaggagcgggagtggagctgcgtgagattgcttcctcttgctgcctgctgagcatggagtagctagcttagcttgcgttccctcgctggcgcttgtgctattgcgtgggcaggacagcggactcctaggtattatctgct

SEQ ID NO: 6651 - DNA, 213 bp, Zea mays
  misc_feature: Incyte ID No: 700352166H1
  unsure 207: a, t, c, g, or other
gactagtcaggcagccaaagtggggccacctaagggatgtgcacaaggccataaagctctgcgaaccagcgctcatagcaactgatccgtcatacacttctctaggtccaaatgttgaggcagcagtatacaaagttggttcagtttgcgcagatttccttgccaacatagatggtcattctgataaaaaccgtcacttccatgggnagtttc

SEQ ID NO: 6652 - DNA, 293 bp, Zea mays
  misc_feature: Incyte ID No: 700352168H1
  unsure 61, 99, 214: a, t, c, g, or other
ctaataaggtaataaggggcgacgaaaatggctccaacgaccgccaccaaggacgacagtngctacggcgacgagcgccggcgcgagctgcaggcgttncgacgacacgaagctgggggtgaaaggcctggtggactccggcgtcaagtccatcccgtccatcttccaccacccgccggaagccctgagcgacataatttctccggcgcctctnccgccgtcgtcgtcgccctccgccgccgccatcccggtggtggactctcggtgacgcgccgcgaggacctagtcgagca

SEQ ID NO: 6653 - DNA, 197 bp, Zea mays
  misc_feature: Incyte ID No: 700352170H1
  unsure 108, 196: a, t, c, g, or other
ctgcagacaccaccgctcgtttttctctccgggacaggagaaaaggggagagagagaggtgaggcgcggtgtccgcccgatctgctctgccccgacgcagctgttacntcctcctcagtctcagtcaggagcaagatgggtgccggcggcaggatgaccgagaaggagcgggagaagcaggagcagctcgcccgant

SEQ ID NO: 6654 - DNA, 288 bp, Zea mays
  misc_feature: Incyte ID No: 700352172H1
  unsure 3-4, 6, 10, 13-14, 18-19, 125, 171, 198, 211, 266: a, t, c, g, or other
ctnncntttnctnncgtnnttattgcaagtctctgcaagaaacctgctagagaggaacaagctggtatcgtcgccagcatgggtagaggaaggattgagatcaagaggatcgagaacaacacganccggcaggtcaccttctgcaagcgccgcaatgggctcctcaagaangcgtacgagctctccgtcctctgcgangtgaggtggcccncatcgtcttctctagccgtggtcgcctctacgagtatgccaacaacagtgtcaangctactgttgagaggtacaaga

SEQ ID NO: 6655 - DNA, 283 bp, Zea mays
  misc_feature: Incyte ID No: 700352173H1
  unsure 75, 92, 144, 186, 198, 226, 274: a, t, c, g, or other
tccttccttccgtcagcgcacatctctagggttttagcgccccatttccgcaacgccattcccgatcggatcgcncccttcccacccgccgncgaccagatcccggcgcgagtgctacccaaccctccggcgccgccacccttnctctcagagggtcggtctccaccgaaagcttcgcacaaatcncctccgtttgtnggtgccattgttgcaaagatgtgttttnctcctcatccgtgcctgcgttccattctgccgtccccgaaaatgccancgctttgtt

SEQ ID NO: 6656 - DNA, 278 bp, Zea mays
  misc_feature: Incyte ID No: 700352174H1
  unsure 262, 272: a, t, c, g, or other
caacacttgcttttcatcccttggagcatttgcattctttgagttttcaccggcctggtgaaacagttcttcacattgctggttctactattgagcttaggtcacgtgatacaagcttagaggttgctgagatgcgcaatgcactctttgctgaggaggaatcgactgctttgtccacatgggcagtggcatccatttgtggagcctcaggttggaacatgtaagacattttgctgccgcactcctggagaaacagattgtnatggctgtcnaatctg

SEQ ID NO: 6657 - DNA, 291 bp, Zea mays
  misc_feature: Incyte ID No: 700352176H1
  unsure 11, 22, 52-53, 96-97, 100, 127, 130, 132, 185, 236: a, t, c, g, or other
ggccaaggganagaaggtggcnccggccccagctgtccgtgaagaagcaggnngctaagaaagtggtgaatcccctgtttgagaaaaggcctaagnnttntggcattggacaggacatccagcccantananacctcacccgctttgtgaaatggccccgctatatcaggttgcagcggcagagngccatcctctataagcggctgaaagtgcctcctgcgattaaccagttcacncaggccctggaccgccagacagctattcagctgcttaagctggcccaccagtaca

SEQ ID NO: 6658 - DNA, 286 bp, Zea mays
  misc_feature: Incyte ID No: 700352177H1
  unsure 20, 24, 30, 59, 76, 85, 117, 124, 136-137, 144, 151, 155, 183, 195, 228,: a, t, c, g, or other
caacatggtgttcagtcgcntcgnggaggntggccgggtggcctatgtctcctttgganctcatgccggaaaattngtcgcgatngtagatgttattgatcagaacagggctttggncgatggnccttgcactcanntgagganacaggcnatgnctttcaagtgcatgcagctcactgatgncatcctcaagtntccgcacagtgcccaccagaagtatgtccgacnagcctggcagaaggcagacatcaatacgaaangggcagncacngatgggccagnngat

SEQ ID NO: 6659 - DNA, 287 bp, Zea mays
  misc_feature: Incyte ID No: 700352179H1
  unsure 222: a, t, c, g, or other
aataaagtataggcgatagaaattgaaacctggcgcaatagatatagtaccgcaaggaaagatgaaaaattatagccaagcataatatagcaaggactaacccctataccttctgcataatgaattaactagaaataactttgcaaggagagccaaagctaagacccccgaaaccagacgagctacctaagaacagctaaaagagcacacccgtctatgtancaaaatagtgggaagatttataggtagaggggcaaacctaccgagctggtgatactggtgtccag

SEQ ID NO: 6660 - DNA, 297 bp, Zea mays
  misc_feature: Incyte ID No: 700352180H1
ctcgaaccctctcgcgcttggcttgctttcactctccagggccccactcccacctccgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgttggaattgagcatccagccgccaggt

SEQ ID NO: 6661 - DNA, 263 bp, Zea mays
  misc_feature: Incyte ID No: 700352182H1
  unsure 38-39: a, t, c, g, or other
gcgcctcaaagaagggtatatccaaggagggcagcaanntgagcgtgatgggtgttgttcaaaggaatgagaacgtgctgatgatcgttcctccggctgaacccatctccactggctgccaatgggccaaatgcatcctcccgaccagcctcgacggtctggtcctgagatgcgaggacacgtctgacctggatgtggtaccagtctagttggttccggcgcggaagaagagaaaagatgcctgactcgattgagtggttctg

SEQ ID NO: 6662 - DNA, 208 bp, Zea mays
  misc_feature: Incyte ID No: 700352183H1
  unsure 185: a, t, c, g, or other
gcagcatatgtggagcatgcaaatgcaattcctaaatggacggggttactgcctaaatctggaaacatggtaattaatacggaatggggaagctttaaatccggcaagcttcctctctcagaatacgacaaagccatggactttgaaagtttgaaccctggagagcagatatacgaaaaaatganctctggcatgtatcgggagagat

SEQ ID NO: 6663 - DNA, 280 bp, Zea mays
  misc_feature: Incyte ID No: 700352188H1
  unsure 98, 235, 238, 269: a, t, c, g, or other
ggaagcactttagcgcctactcttccctgatttatcaccagagattccacaccggagagaaaccctataaatgtaatgactgcgggaaagccttcagngatggctcaatccttatccgacatcgtcgactcacaccggagagaagccatttgagtgcaaggaatgtggcaaaggcttacacaaagttctaaccttatccaacatcagagaattcacactggagagaaaccctatnaangtaatgaatgtgagaaagctttcattcaaanaaccaaactcg

SEQ ID NO: 6664 - DNA, 270 bp, Zea mays
  misc_feature: Incyte ID No: 700352189H1
gtataaaggagtctgatacagggttggctccacctagccagtgggatttggtttcagataaacagatgatgcaagaagaacaaccgttacaagtggcaaggtgtacaaagatcataagccctaatacggatgatgccaaatatgttataaatgtaaaacaaatcgcaaaatttgttgttggactgggggataaagtgtctccaactgacatcgaggaagggatgagggtcggtgttgatcgcaacaagtaccagattcaaatccctcttc

SEQ ID NO: 6665 - DNA, 275 bp, Zea mays
  misc_feature: Incyte ID No: 700352190H1
  unsure 19, 47, 85, 104, 126, 153, 170, 176, 195, 224, 228, 253, 266: a, t, c, g, or other
caccattctcgcgccggtnaattcgcctaataccgatggaattgacncgggtagctagagaccagttagcttcctttgacgctgngaagtgagaagcacatgtntctgattctgaatttcattgcntgtgcgtgtgtgcagattcttcctcgngtgtcaagatcgaggantgctanatcgtctccggcgacgacngcgtcgccgtcaagaacgggttggacgantacngcatcaggttaacatgcgaaccagnacacgtatccgangctgagtgg

SEQ ID NO: 6666 - DNA, 284 bp, Zea mays
  misc_feature: Incyte ID No: 700352192H1
gctcaggggagcggaggagacgcctgccctagtccacctcacgcacatgaccgacctgcagtcggtctaccacctgcggatcggcttcgcctccgtggcgtccagaccgtctgccaccggctccatgtggtacatgtgggtgctgtggcccgtggcgtggctgtccatggcgctcgcgtgggcctacgggtcctccgcgttcgtcgtcgagaggatcaaactcgggaagctgaggatgcaaacgtgggcagtgccaagatacaacttccagtacggcctgagct

SEQ ID NO: 6667 - DNA, 285 bp, Zea mays
  misc_feature: Incyte ID No: 700352193H1
  unsure 103, 163: a, t, c, g, or other
gctgcacagtgccacaccgctcgcgctggagtatgggttcgagcccgatgtggtggtcaggaccaccaccgtcgccgtggagccgcggtttagggaaatggtnggcgctggtagggccattcgtggtgaaggccgtcgggttcctgctgctcgcgggcctctngttccgggtgctctggtcctttccgtcctctccggcgccggcgttgcagatcacaaaaggaaaatgcagtcttttcaatggggaatggataccaaacccctctggtccagcctatacaaatg

SEQ ID NO: 6668 - DNA, 117 bp, Zea mays
  misc_feature: Incyte ID No: 700352195H1
gtttttacaatgcttaactttttaggtgagtggttgtttgctgggaatgtacagtatttggctcaaaattcaaaatgtttcagaagctcaatccaatgaaacaggccttgttttttt

SEQ ID NO: 6669 - DNA, 305 bp, Zea mays
  misc_feature: Incyte ID No: 700352201H1
ccacatcagaacacatactattggcatatggtcggcaacatagttcactgttgaggaccattttgatcaatggggagaccagagttcctgtgtacacagtcttggaggtgtatcgagtttcagacatggagcttgtaagagttcttcctagtgtaggagaggaagtcaatgttgcatgttttcatccttcccctggatcaggtcttgtttatgggactaagcaagggaaggttaggtttcttcggcaccatggtgcatcattcacttgctggggagaacgttcatgagatttagaggcatgtgct

SEQ ID NO: 6670 - DNA, 300 bp, Zea mays
  misc_feature: Incyte ID No: 700352203H1
  unsure 32: a, t, c, g, or other
caggcagcatctgcatctctcgcccacctccnctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaaatcttcctgggcgacatgtggtccgcatgaagtcggagaagaagcgcca

SEQ ID NO: 6671 - DNA, 299 bp, Zea mays
  misc_feature: Incyte ID No: 700352205H1
  unsure 298: a, t, c, g, or other
ggggagacccgtttatattgaaaggcttggaaaggttgaccctagcaaacttatgaatgtcacaacgatggatcgatatgtgcgataccatgtgaaggagtttgagaggagcttcttgattaaatttccagcttgctctgttgctgcaaaaaggcacattgattccagcacaacaattctggatgtccagggcgtgggtttgaaaaatttcagcaaaactgcacgtgaattaattcagcgactgcagaaaattgacaatgatactacccagagactctataccaatgtttattgtcang

SEQ ID NO: 6672 - DNA, 295 bp, Zea mays
  misc_feature: Incyte ID No: 700352206H1
  unsure 9, 12-13, 23, 27-28, 31, 64, 94, 104, 110, 112, 125, 127, 131, 136, 147,: a, t, c, g, or other
aggcatagnccnngggatcccangaannagnaagggaatctcgtgtttcttcttaagacttttnggacatggtttgactcccgaacatcaccgncgtgtctccngttttncngggtggcctcggnanaccngcccngcccccacganggtcangactgtgactcttgttacggccaggcaggtgcctggacatttgccttgctgganggggactgnngatgtgnnatggagcagncaggaggaatcatttcaggcctgtgtgtgaaaggaactccantgtcacncgcanctctga

SEQ ID NO: 6673 - DNA, 303 bp, Zea mays
  misc_feature: Incyte ID No: 700352208H1
  unsure 85-101: a, t, c, g, or other
cgcgtccctttcccttcttcccatccacgccagccaagttcaccgccgcgctctccggcggcaactactgttggatcgtagggcnnnnnnnnnnnnnnnnnggagccatgggaaacgcgtcgtccatgctgacccagtacgacatcgaggaggtgcaggagcactgcagctacctcttctcgcagcaggagatcgtgtcgctgtacgagcgcttctgccagctggaccgcagcgccaagggcttcatctccgaggacgagttcctctccatccccgagttctccctcaacccgctctccaaga

SEQ ID NO: 6674 - DNA, 298 bp, Zea mays
  misc_feature: Incyte ID No: 700352210H1
  unsure 254: a, t, c, g, or other
gttcctctctcagtctcggggcttcttctcgcgggcacctccggctgcttcctttgccaccgcagcaccagcgctgtccatggagcccccgccgctctcctcgttgcaggaggagggggaggaggggcctaccgtcgaggactcgtccgtcttctccgccgccgttgtgccgcctcgccccgccacgcaccactcgctccacaagtacgcgcctctggactggtccgcctacttcgacgaggagcgccgcgtancatccccgacaccgacaacgttttcaatgcgtacacgaccggat

SEQ ID NO: 6675 - DNA, 298 bp, Zea mays
  misc_feature: Incyte ID No: 700352211H1
  unsure 18, 64, 235: a, t, c, g, or other
atcaaggccattggcgantgctaaccgaatcaagatcaagaaggcattacggggcgtaaaagtngaggtcacgcaccgggggaatgtaaggcgcaagtatcgcatatctgggctcacaacacagccaactcatgaactgattttcccaattgatgaacaaatgaatatgaaatctgtcgtggagtacttcaaggaaatgtatggtttcaccattcagcatcctcatcttccttgnccttcagttggaaaccaaaagaaggcgaactatttaccaatggaggcctgcaagatcgttgaa

SEQ ID NO: 6676 - DNA, 256 bp, Zea mays
  misc_feature: Incyte ID No: 700352214H1
  unsure 52, 145, 148-149, 151, 154, 156, 161, 186, 240: a, t, c, g, or other
tcaatctgccccgttcttggctgcgaggcgatctttgtgccacccaccagancgcgaggggcttcattcacctgatcctcgcttcttcttcttccgtcccactggttcgcgttgattgcatttggaggagggggcagtcaagatnagnntnggntnctggnctgctgctacaatgatccggagatncggatcgatccggacaccgtctaccccatccgcgccgactgccgcgacgacgcncccaagacgcgcttca

SEQ ID NO: 6677 - DNA, 300 bp, Zea mays
  misc_feature: Incyte ID No: 700352217H1
  unsure 35: a, t, c, g, or other
gctccaatccgccgctccactccaagtcacacggnggcagccatcgtagcctcgcccgactccgcttcccctgttctttgggcatggagctgatcacaaatgtcaccgagtacgagaagctcgcgaaggagaggctgccgaagatggtgtacgactactacgcctccgggcagaagatcagtggacgctcaaggagaaccgggaggccttctccagaattctgtttaggccacgggtactgatcgacgtctcccgtatcgacatggccacaaacattctgggttcagcattccatgccta

SEQ ID NO: 6678 - DNA, 296 bp, Zea mays
  misc_feature: Incyte ID No: 700352219H1
ggagatcggcttcatcgtctactccatcggcaagccgctcgacgcctggctcaaggacatgcccgcggtcgcctaatcccacccccctcacccatggattggattccgggaaggaagaggagagaagctggttgaccgttctttattacagtttgtttttgcaggctacgctaccgattttctcttgtgtcaggcataaaaaaaggttggacgggctgctagtattccctgctgtttggtgttttcgtatcggaggacgtctgtagatgtacaattcctcaggcccttgtgttcgg

SEQ ID NO: 6679 - DNA, 299 bp, Zea mays
  misc_feature: Incyte ID No: 700352223H1
ctagggtttttgattttagccgccgccgctgctcatctcacatccctcgagaagacgcctgctcctcgcctctacgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgt

SEQ ID NO: 6680 - DNA, 296 bp, Zea mays
  misc_feature: Incyte ID No: 700352228H1
  unsure 97: a, t, c, g, or other
aagatgagcactcctcaaaatcagatgatgacatggatgaccttgaagagttggatatctcgtcgtgtttcatgtgtgacctcaagcatgacaccanagaagactgcatggtccatatgcataagaagcatgggtttttcatacctgacagtgaatacttgaaggatcccagtggtcttcttacttatgttggactgaaggtgaagcgtgattttatctgcctctactgcaatgacagatgccagtccttcttcagtctagaggctgtcaggaagcacatggatgcaaaggggcat

SEQ ID NO: 6681 - DNA, 294 bp, Zea mays
  misc_feature: Incyte ID No: 700352229H1
  unsure 142, 212, 238, 265, 270, 277, 291: a, t, c, g, or other
atccctcgctgccccccacactccagaagtccagaccaaagctccaaagtccaatccctcgctagccacttgccatctgatcaaccagccagccgatctcagcgatccgccatggccaccgcgtattacgagaggccccgtngcggcgccgtcgaggaggcggacgacttcgatgagttcgaccccacgccgtacggggtgggtacgacctngccgtcacttcggtcgcccgtgccancgaccgaggaaacctgctacccgtgcnggcgnctcgacntctacgacgaccgncta

SEQ ID NO: 6682 - DNA, 303 bp, Zea mays
  misc_feature: Incyte ID No: 700352230H1
  unsure 22, 198, 204-205, 209, 217, 222, 225, 227, 232, 243, 250: a, t, c, g, or other
aaaccgtttaccgccgccgganaagcgccgctcgctcaggaggacagccatggcgccggagccggaggatgatattatgaacgagaagaatccccgcccgctcgacgaggatgacatcgcgctcctcaaaacctatggactggggccgtattcgactagcattaagaaggtcgagaaggagatcaaggaaatggccangaaatnnacgncctctgtnggatnaangngtctnatacagggctngctccanctagccagtgggatttggtttcagataagcagatgatgcaagaagaacaaccg

SEQ ID NO: 6683 - DNA, 304 bp, Zea mays
  misc_feature: Incyte ID No: 700352232H1
  unsure 22, 65, 190-192: a, t, c, g, or other
caaggagacgcccggatctggngcgcccgccccggctaggaagccacccttgcacgcctccggangcggcggcgggtgggacgactgggacgatgattttcggtcggacatgaggcggaatcagtcggttggatcattcgccgccgcgggggcgcagtcagggaggcagccgccgaggtccaaatcaacnnncgacatctacactaggcagcagctggaggcgtcggcggctaataaggatgatttcttcgccaggaggatggcggagaacgagtccaagcctgagggtatcccgccatcccag

SEQ ID NO: 6684 - DNA, 294 bp, Zea mays
  misc_feature: Incyte ID No: 700352234H1
cgccgcgctgcccagggtcgccatggacccgttcgagtactgctacaactggaccgccggcgcgccggagatccccaagctggaggtaagcttcgccgggtcggcgcggctggagccccccgccaagagctacgtcatcgacgcggcgccaggggtgaagtgcatcggcgtgcaggagggcgcgtggccaggggtgtcggtcatcggcaacatcctgcagcaggagcacctctgggagttcgacctcagggaccgctggctccggttcaagcacacgcgctgcgccctatgatg

SEQ ID NO: 6685 - DNA, 290 bp, Zea mays
  misc_feature: Incyte ID No: 700352235H1
caattgtcggttcttcacttatgaggaattgtatcagatcacaaattgcttctcatcacagaacctgctaggggaaggtgggttcggatcagtgtataagggttgcttggctgatggaagagaggttgcggttaagaaactgaaagatggcggcgggcagggggaacgtgagttccatgcttaggtggatattatcagtcgtgtgcatcatcgccatctagtttctcttgtggggtattgcattcagatgaccagagattgcttgtctacgattttgtgcccacgacaca

SEQ ID NO: 6686 - DNA, 291 bp, Zea mays
  misc_feature: Incyte ID No: 700352236H1
cgcttcggctccaggccatggagcagcggaggtggctcgcggtagccgttttgatgtgcctgctggtgctttgctccgggagagaactgaagaccaaacatgtgcccatatatgacccagtgctggcccggacacttgctgaatatacttctgctgtctatactgctgaccttacccaactgtttacatggacatgtgagagatgttgtgacttaacagaggggttcgaggtgatagagctgattgttgatgtgaaaaattgcttacaggcatatgttggatttgctagag

SEQ ID NO: 6687 - DNA, 290 bp, Zea mays
  misc_feature: Incyte ID No: 700352237H1
  unsure 20, 23, 246, 263, 267-269, 275: a, t, c, g, or other
atttgccggcggtgcccgcngcngagaggatggcgagctccttctccttcccgctgatgaatccggcggacattgcggaggcgctgcacagctactgcatcgcgcccagccccggcctccgcgccgagcacatcgtcaccccgcagcccggcctcgtcgccgaggtcctcgccctcttcctcgccaacttcgtcggcgacgacgagcccgacgagcagctagagtttcaggcgctgcaggcgatcnacaacccggagcaacantgcnnntatagnctctcgcgtctatag

SEQ ID NO: 6688 - DNA, 289 bp, Zea mays
  misc_feature: Incyte ID No: 700352238H1
  unsure 28, 33, 62, 222, 228, 230, 260, 264, 266, 287: a, t, c, g, or other
aaatgaactctaccaattggcctccgtngcatnttgcttgcttctagcctggtgcagtgacnatttcggattgagtcttgagttggggtcatttcttgctggtgttatgatatcaaccacagattttgctcatcatactatggagcaggttgaagccattcgcaatctatttgcagcactcttccttgcaagcattggaatgctcatacatgttaagttctngtggantnatgtgacatattacttgcagctgttatacncgtnanatggtaaagagtaggccgganct

SEQ ID NO: 6689 - DNA, 288 bp, Zea mays
  misc_feature: Incyte ID No: 700352239H1
  unsure 189, 191-192, 199, 203, 207, 211, 214, 219, 222-223, 226, 235, 240, 260,: a, t, c, g, or other
ccggagcagccgcagtcccaccgaccccgccgccggtcgccctccatctcctcgccgctgcctctcgatctttgtacagtttctcttttcaataatcaagatgagccgtggtggtagtgccggtggtggtcaaagttctctgggttatctctttggaagcggtgagccccccaaaccagcagtggcacnanntgaaagngctncacntgtnganacaanatnntcnaagactgtncggcnaagaagttgctgctggggtnacagccanaccataactacanagggntg

SEQ ID NO: 6690 - DNA, 282 bp, Zea mays
  misc_feature: Incyte ID No: 700352240H1
  unsure 208, 242, 245, 276: a, t, c, g, or other
aagagaagagaggctaaccaccgcagcagctgcgacctgcgagtgcgacaacctccgcggaggagttggagccggcggcggggatatttgcttgcccggctggggttgcggcggaaggagggagagacaaccggcgatggcggcgtccgcgaggcccggggagagggcgacaacttcgccgtcgcgtgcagcctcctcagccgtttgnccgccaaaacggctcgcggctgccgactagcttnagntcaaaggcaggtcagcagcaaagacgccgcnacaact

SEQ ID NO: 6691 - DNA, 266 bp, Zea mays
  misc_feature: Incyte ID No: 700352241H1
  unsure 164, 174, 185, 196, 262: a, t, c, g, or other
cagccgacgatgaccaccgccgcggacgccgacgtcgacgactaccaccactccgacggattcgtcatgtccgacgtcctcgccaagggccgggaggctagctacaaggcacgggatgccttctacgcgtgcatagagaagcacgcggacaaaaagcccacganatccgcaacnatgggctcttnacccggccgantgcaaaaagtcccgcgccgacttcgtcagcaactgccgccccacctgggtcaagcattcgaccggnatat

SEQ ID NO: 6692 - DNA, 284 bp, Zea mays
  misc_feature: Incyte ID No: 700352244H1
  unsure 7, 85-86, 88-90, 94-95, 98, 187, 189-190, 195, 197, 200, 204, 210, 214,: a, t, c, g, or other
gcgagangtcgaggcgccgctgcttgctaggaccgagcttcaggaagtctccaacggccccggcgccggcacggcctgccccgcnncnnncgcnngancgattgtgatcagatctattctgtagtggtcagcggctgagggtgaaccgaagatgagcgttgtgggattcgatctcggcaattatagngnnttgtngnagnccgncggaangtgnatngangggtcntcnagatggtccaagcgngagacanccgcatcgttgcttcggggaaagcagcgttatc

SEQ ID NO: 6693 - DNA, 285 bp, Zea mays
  misc_feature: Incyte ID No: 700352245H1
  unsure 160, 166, 168, 176, 178, 180-183, 185, 193, 203, 251, 261, 268, 275, 277,: a, t, c, g, or other
ggaagaaaatacaataactgagaccagatgtccagatgataactggaactcctgtcagtttgcactgaacaatggttcgtccattctcaataaccacagtgctccccaggatagcctcacttatggagataatgatctaaactacatcgaatggcctggnatgacnantttgaagngncnnnncnttattcangagttctgantcaacatatggtcagcagcagctggagaatgcagagggttatcttggnttccggcttnagatgcngggtacncnaccgntgt

SEQ ID NO: 6694 - DNA, 161 bp, Zea mays
  misc_feature: Incyte ID No: 700352246H1
  unsure 31, 34, 38, 43, 128, 132, 138, 143, 149-150, 152, 155-160: a, t, c, g, or other
gaaccctacccatcccgcagcgccgccggcngcncgcnccgcnccgccccttcaccccctacctcttcttgcgccgtcatcccgatcccctacgctcgctgaggcattatgggtaaatcaagcaagangtcnagtgtnaaggntgaacnngntgnnnnnna

SEQ ID NO: 6695 - DNA, 296 bp, Zea mays
  misc_feature: Incyte ID No: 700352247H1
  unsure 166, 186: a, t, c, g, or other
ctcctccaagcacggattaggagtgcatttattttgattctgcgaactgagtaactgatttctaaagatgggtgtgaaggagatgtatcttcaatattacaatagttacaaccagtacctacgaagaagaagggtgctcatttgcactaccatttgtgtggttttnttgtggtataaactgtctanattacataagaagagtatcaaatatggtcctttgttacaacgagatttggaacgagagaggcggctcaaccggttgtttaatgggacagaagccaattgtattagtgagt

SEQ ID NO: 6696 - DNA, 300 bp, Zea mays
  misc_feature: Incyte ID No: 700352248H1
  unsure 286: a, t, c, g, or other
aacagatcctctctggacgaacagaaaggttaccagcagcaccacggcgagatctccccttggcgggccaaaaccgacggcgagcttcaccggcgttggtcggctccaatctcttcgccgtttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggntcttcggagcaggt

SEQ ID NO: 6697 - DNA, 291 bp, Zea mays
  misc_feature: Incyte ID No: 700352250H1
aaatgaggcagcaagctcacgagacagggagggccgcagctatacccatcacggtgaggcagctagaagccatcatccgtttgagtgaatctcttgcaaagatgagattgacaagtgtggctacaccggagcatgtcgaagaggcattcagactgttcaatgtctccaccgttgatgctgcaagatccggaatcaatgagcatttgaacctgtcaccggagatcgcaaatgaaatcaagcaagcggaggcacaaataaagagaagaatgggcatcggcagccacatatccg

SEQ ID NO: 6698 - DNA, 289 bp, Zea mays
  misc_feature: Incyte ID No: 700352251H1
  unsure 265-266, 271, 288: a, t, c, g, or other
aattgcttcatcctcacacagagttgtttctcgcctccggtcagttgcagctgggatgcagtgatgcagagacaaccatggccaccacctatgcaatccaaccgtgttgtgagcatcaccgaccgccacaccgaggaggccagccccgtgcgcaaactggttgccgagatcattggtgtgcttgggtcaaaacacatgagaactgtcacgccgcttcctgacaccggtcaatggctgcttctatcattgatcgagaagctccctnnaaagngtggttgatctactgana

SEQ ID NO: 6699 - DNA, 282 bp, Zea mays
  misc_feature: Incyte ID No: 700352252H1
  unsure 127-145, 165: a, t, c, g, or other
gacaggaaaggacggtcccgtctctcccgatacgcttccgaagcggtcgcggagcaggtcggacggtccgccaggaagatggggttgagctccatcgtcatgaaggtgaaaggggcttcgttcttcnnnnnnnnnnnnnnnnnnntcctgagcttcagagaaggnttccgaggcgaaagggtgagggaccaatctcctatcatgtacatccacgacgtgacccagcttcctcacaatgggtgccggctccccaagcagcgccgggtgtagtttcggagtgga

SEQ ID NO: 6700 - DNA, 282 bp, Zea mays
  misc_feature: Incyte ID No: 700352253H1
  unsure 276, 279-280: a, t, c, g, or other
gctaaatgaattgtactacgctggaagccatggaatggacataatgggccctgttaggaagactactgactccaatggcgtggaatgtattcggtcaactgatgtgcatgtgaaactactttctagatctttaccctcaatttaaatgttttacttgctttcttagtgtgtatcttcttatcctcctcgtagggtaaagaagtcaacctgttccaacctgctagtgagtttttacctatgatcactgaggtgtatgaaaaactgggtgagagtgtnaannac

SEQ ID NO: 6701 - DNA, 278 bp, Zea mays
  misc_feature: Incyte ID No: 700352254H1
  unsure 153, 185, 194, 240-242, 244, 247-248: a, t, c, g, or other
aaagaagaagtcagcttggcggagtgggcgttgcactgccagaagaagggcattcttgaccagattgtcgacccctacctgaagggaaagatagccccacagtgcttcaagaagttcgccgagacagccgagaagtgtgtttctgatcagggnatcaccggcccttcgatgggtgatgtctctgnaccttgganttcgccttcagatgcaggaaggcgcagaagagagcggaacctttgnnngnggnntgtcagacgagggcgcccccttgatggtcg

SEQ ID NO: 6702 - DNA, 287 bp, Zea mays
  misc_feature: Incyte ID No: 700352256H1
  unsure 58, 127, 166, 179, 193-194, 196, 208, 211, 217, 240, 244, 267, 286: a, t, c, g, or other
ctcttcctctcctccatctctcaacgcctgtaagctcaccgcacctcccctcctcgcngcggatcccccactactccggtagaaaatggctgacgctgaggatatccagcccctcgtctgcgacaanggaactggcatggtcaaggctgggttcgccggcgaggangctgggaggggcngttctttcccgagnntngttggggcgccngcncaacancggtgtgatggtggggatggggnaganggatgcctacgtcgggcgacgangcgcattccaagaggggtnt

SEQ ID NO: 6703 - DNA, 286 bp, Zea mays
  misc_feature: Incyte ID No: 700352259H1
  unsure 187, 204, 211, 215, 223-224, 251: a, t, c, g, or other
aaatttggcaagaggaagtctttggaccagttatctgtgttaaggagtttaggacagagagtgaagctgtggaacttgcaaatgatactcactatggtttagctggtgccgtgatctccaatgatcaagagaggtgtgagcgcatttcaaaggctcttcactctggtattatttggataaattgctngcaaaccatgcttcgtncaagccncctngggggagnnaacaagcgggggttttgggtcgggaanctcggaaaaatggggtcttgataactacctgacag

SEQ ID NO: 6704 - DNA, 282 bp, Zea mays
  misc_feature: Incyte ID No: 700352261H1
  unsure 72, 118, 165, 219, 224, 238, 240, 259, 281: a, t, c, g, or other
tcctgcacgcaacctcatctcgtcctccagatcctggatggacgtcctccttgataccttgcctcgcgagtnctctcggtgagctactttgttttgatttatcaggaaatccgtttgnttcatgttatgcaggctcagatctgattgctggattcggcatcttangggcttgaatagagctaggactgggagaaaacaacaaacccgcgtggaacctgnatcgnttagtcctgcctgnanggttcatgttgttttgttntggtggtcgagcatcgaatgtnc

SEQ ID NO: 6705 - DNA, 288 bp, Zea mays
  misc_feature: Incyte ID No: 700352263H1
  unsure 4, 24, 31, 59, 133, 136, 146, 158, 160, 164, 172-173, 178, 180, 182, 191,: a, t, c, g, or other
caangggtcataatggtggaagantcatctntgatgattatcgtgaggcatactattgncttcgtcagaacacgcctcctgatgcgaagattatgtcttggtgggactatggataccatattacagctatggntancagaactgtnattgttgataanantacntggaatannacacncntngctacagtnggacgngctatgtgcatcttatgaagatgaaagcatatgaggtcatgnagtcacttgntgtgaattatgtgcttgtngtgtttggngtgtactgant

SEQ ID NO: 6706 - DNA, 296 bp, Zea mays
  misc_feature: Incyte ID No: 700352264H1
gtaatgtgcgagatgtgaggaattccatatttgtgtggcgaggcaagccgtgcgacaagtgccagatgtacgatgaaatgattgaatcggagagcgtcaccgtttgtgtggattatcaagtcaggcaaataacggtcacttggtcgtggaagggcttcttattgcagtcatagtgttccagctctccaggaagagttacaaacccaccaaagaagccactccactggaaaagtgccgctggaccacatacgattgttgatggtaaagaagtgtgaactttgcatcagcaaactacc

SEQ ID NO: 6707 - DNA, 284 bp, Zea mays
  misc_feature: Incyte ID No: 700352265H1
agcctgtctctcgtcatactcaatgtggccctctgatttagtcccaagcaagggttgctcgtgcttcttagaggcttttacagtcagagtcctgatatctgaacttgcacactcattttctggtcgatcaggcacaggatccacaggtgaccgttcctcaacttcgcatggactgtcagcaggcgcagtggtatcctcttcaatgtgttcgtcagattcatcaatgtcctggatagctaatggcagcattctgcatcaattggcggagttccagccacaagttc

SEQ ID NO: 6708 - DNA, 280 bp, Zea mays
  misc_feature: Incyte ID No: 700352268H1
cgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtacccaccgcgccggctaggggagcgttcggcaacatgtgtcgtggtggacgcatgttcgcgcccaccaagatctggcgccgtggcac

SEQ ID NO: 6709 - DNA, 279 bp, Zea mays
  misc_feature: Incyte ID No: 700352269H1
  unsure 35, 156, 159, 166, 189, 256: a, t, c, g, or other
atcgccgctgcgccgtctcctccgctcccgtcgtncggaaagatggcgtcccacattgttggataccctcgcatgggccccaagagggagctcaagtttgcacttgagtctttctgggatgggaagagcaccgctgaggatctggagaaggttgcnacngaacttnagggccagtatctggaagcaganggctgatgctgggatcaagtacatccccagcaacactttctcgtactatgaccaggtccttgacacnactgccatgctggggctggtccc

SEQ ID NO: 6710 - DNA, 275 bp, Zea mays
  misc_feature: Incyte ID No: 700352270H1
  unsure 134, 172, 177-178, 183, 187, 189, 191, 201-202, 208, 237, 240, 272, 274: a, t, c, g, or other
gagagattcctaaatgcatattctacactcgaacatcttgacatgcagttcttagactgcaggcatactttgaagtctagtgttgaggcctttctcagtgaaaatgatactgacccagccacacctcaactggngaccaccatgtttgccccctggactaagaagggagatntaaanngggancctngnangccccagggnntaccanagtcttgctaatttcaaagaagtcctacnggntcaggtttagagatttggacagcggcccgganana

SEQ ID NO: 6711 - DNA, 206 bp, Zea mays
  misc_feature: Incyte ID No: 700352271H1
  unsure 2, 74, 77, 90, 93, 114, 120, 125, 127, 133, 135, 147, 154, 159: a, t, c, g, or other
tncaggatgcattccacgaacctcctgctcgaggagcccatccggatggcctccatcctcgagccctccaagcncanctacttcccggcnatnaccaagatcgtcggcactctnggcccnaagtngngctccntngacacgatctcngcctgcntcaangccggcatgtccgtcgcccggttcgatttctcgtggggggacgccgc

SEQ ID NO: 6712 - DNA, 276 bp, Zea mays
  misc_feature: Incyte ID No: 700352276H1
  unsure 45, 74, 132, 152, 166, 168-169, 188, 199, 205, 214, 223, 225, 235, 239,: a, t, c, g, or other
aaaggatgatagtattgtagatgagaatagcatcactgctatgtntaagttcaccatctctctcataaagatgnatagaattgcgccagatagtagtaaggataaccttgccaagcacattagttccatgtnggttattatcccaagcaggnggcatttggtgcangnngtaattggagaagttgacncgggaattgcncacgcngttcgttcnattctgatnangccaaatgcntgcngtcccagnggcaaaccgtcaatggcntncctnanggc

SEQ ID NO: 6713 - DNA, 285 bp, Zea mays
  misc_feature: Incyte ID No: 700352277H1
gagttggacctgccagatgccccagaaaaagccccacgtcctcctgcacaagctgttgacccattctcaaaatttgggccaaaggcagagatatcacatatattccgcgcaccagagaagaggccacccaaggagctctcgctagcgttcacgggtctcacgcttctgccgtttattggattcttgatagggctcgttcgtcttggagtgaacttgaagaatttcccgtccttgccaggaccggccgcatttgcctcaatttttccatgcctgggataaggagca

SEQ ID NO: 6714 - DNA, 283 bp, Zea mays
  misc_feature: Incyte ID No: 700352278H1
  unsure 44: a, t, c, g, or other
ctttcgtggagtacgaaactcctgaggatgctgcgaaggctatnttggagctcaatgatgagaaaaactggagaaatgggcttagagttcggttgctgaatacttgcacggtgaagggggcaggcaaaggaaaaaacggaatgaatgaaactgatggaaatagtgaggaggatgtctccactttgaaccattctaacgagaaacagtttgaacaatcctctcaactgttagatgtactgccggaacacttgtttgatgagaattccaccaaggaagtcccaag

SEQ ID NO: 6715 - DNA, 285 bp, Zea mays
  misc_feature: Incyte ID No: 700352279H1
  unsure 222: a, t, c, g, or other
atatatgtgtagtaaaaaataagcgtatagattcagatattattgccaaggcaactcagatgaagattataatgcagtatggtgttgggttagaaggtgttgatgtaaatgctgctacagaacacaaaatcaaagttgcacgaatacctggaagtacgacaggaaatgctgtctcttgcgcagaaatggcaatctatcttactctaggcattctgcgtaacnaaaggagatggatactgctgtgaaccggaaagaccttggtgttccagttggagatacattatt

SEQ ID NO: 6716 - DNA, 278 bp, Zea mays
  misc_feature: Incyte ID No: 700352281H1
actgccctcgcttggtgctcagttctttcctctgctcctccgcctcttctcgcacctcggcaccttcttcggcaactgcgagcgagatggaggcgcaagacgactgcaagtggcggcagatcccggcgttcggcgactggaacgtgtgggacggcgacatgcccgtcacccagtacttccaggcaggggccttcttcttcgcggcgccggcggagaagggcgacgcggatctcttcaaggtgccccagttgcctgccaagccctacggctacaagaag

SEQ ID NO: 6717 - DNA, 277 bp, Zea mays
  misc_feature: Incyte ID No: 700352282H1
  unsure 162, 164-165: a, t, c, g, or other
tctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctnannagagccgaagaattaatccatgttggtcaaaagcagtcagccctgcaggctttacatgatctcattacctcgaaaaggtacaggtcatggcagaagcctctcgaaaagatca

SEQ ID NO: 6718 - DNA, 274 bp, Zea mays
  misc_feature: Incyte ID No: 700352284H1
  unsure 205: a, t, c, g, or other
caggagccgccgcagcaaggccagggcctcagcctctcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagggncagctaccaaaagcagtgctgcccctactgttaagcctccaatggtgcctgcagccactgttgccccag

SEQ ID NO: 6719 - DNA, 261 bp, Zea mays
  misc_feature: Incyte ID No: 700352286H1
  unsure 120, 127, 139, 141, 151, 153, 157, 160, 164, 166, 178: a, t, c, g, or other
cccaaggcgaggcgttgaaacccttaaccctcttccacctcgaagcggcgcgacggagggagagtgtgagtggactcaggaggcggcgggcgaaatgaagcttaacgtcaagaccctcangggcacnaatttcgagatngnggcgaccccngntgcntcngttntnaggtgaagaggntcatcgaaactactcagggtcagagtacctacccagcagaccagcaaatgctcatataccaagggaaaattctgaaggatgag

SEQ ID NO: 6720 - DNA, 123 bp, Zea mays
  misc_feature: Incyte ID No: 700352288H1
  unsure 17: a, t, c, g, or other
cggaggtcctccctggncgtactccgaaatctacccactccctccggcgccgctgcagtgccacccctccatcggtccatccccaatccgctatgcaaccgctactcctactgctactcgctt

SEQ ID NO: 6721 - DNA, 272 bp, Zea mays
  misc_feature: Incyte ID No: 700352289H1
  unsure 192: a, t, c, g, or other
atggggcggacctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctataaaaaaggttcttcaagacaagagatacaagantcgtggagctgcaaaccatgcggagtgcttgaccacccaaatgtggtggctctaaagcatgtttcttctcaaagactgag

SEQ ID NO: 6722 - DNA, 113 bp, Zea mays
  misc_feature: Incyte ID No: 700352290H1
aacaatagaaaggaacaggggggaagaacaccaaccaagcaggacttggtttttgggaactccatgggctgtggaattgtccccaggaatcccctctgggcttgacgagattc

SEQ ID NO: 6723 - DNA, 274 bp, Zea mays
  misc_feature: Incyte ID No: 700352291H1
  unsure 183: a, t, c, g, or other
gatgcaagagaggaaagccaaacagcagcagtcgctgaaaaaggtcattgatgtgaagctgcccagcgtcaccgacatggagagaagtcctaaaggagagactggatcaacagaagttactggggttgagactgacgtcttgaacaaagagcgtttattaggcaaagcaggagagaaaaatgngcgagaaaggaaatgatgtcgccccacaggacccgaaaacacaaactgagaagttggcgggtctaaatggctgttaatatttttcgttagc

SEQ ID NO: 6724 - DNA, 272 bp, Zea mays
  misc_feature: Incyte ID No: 700352292H1
ggggatcgatcttgttcgcggagaggggtgacgtgcttgacagttttgactcgaatccatggtgtgcatctctaccagatagagagctgacctgaggtggagacgtggatcgtggctcctggggtggaggtacaagcgtacagctcaataggagatcaagagtaaagagtgtggggaggggaaggacgcgatatcgggggaggatggtgcttgtgcttgcgctgggggatctgcacatcccgcaccgggtgcccgacctgcccgccaaatta

SEQ ID NO: 6725 - DNA, 277 bp, Zea mays
  misc_feature: Incyte ID No: 700352293H1
  unsure 27, 29, 246, 251: a, t, c, g, or other
ataccccgctcctctcctccccgtctncnggctcccttcttcttcgctgtcgacgacgcggactccccgccgcgctccctctctcaggcctcgcggggtgatcagaggcggctgggagactcgtgcgctccgacgagtccggttacggcgcggtaattaagcaggggaggagccggccctgagcggcggagtccaaaatgagtgacgacgtggtatggcaatgcatcggccacaaccactgcagcntcatntccaagatcacaacggggaatctctg

SEQ ID NO: 6726 - DNA, 285 bp, Zea mays
  misc_feature: Incyte ID No: 700352296H1
  unsure 25, 148, 187, 267, 280: a, t, c, g, or other
attaaccctcgttcctgtcgcgcancacgacctccacttcacatctcccccggcggcggcgcggtcagttgaacaatggcggacttccaaggccacctcggcggtcaccctccgcacccgcaagttcatgaccaaccgcctcctggcncgcaagcaattcgtgttgaggtgatccaccccgggccgngccaacgtctccaaggcggaattgaaggagaggtttcaaaggcgtacgaggtgaaggacccaaacaccatttttgtcttnaattcggaaccantttgg

SEQ ID NO: 6727 - DNA, 301 bp, Zea mays
  misc_feature: Incyte ID No: 700352302H1
  unsure 297: a, t, c, g, or other
aggtgatctgcatgtgcctgtgatctactgctggctgcatcacctcaatagtctacctgggggcgtatgacagcgaggaggcagtgcttcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgcaggcatcaccacaacgggagtgggangcac

SEQ ID NO: 6728 - DNA, 300 bp, Zea mays
  misc_feature: Incyte ID No: 700352304H1
  unsure 279: a, t, c, g, or other
gcaggcttcgagaacaagactgcagggggagggggaggaccaagcgaaaggggaactagagcaagatgggcggcgcactgctgcttgcgctcctcctcgtctctgctgctgccgcccctcaggtacttggagttggcaatggagacaatcacatgagaatcatccaggaggacatcatcgagacagtcaacaaccatcccagtgctgggtggacagcctcacgtaatccttacttttcaaactataccattgcgcaatttaagcacatacttggagtgnaaccagcaccacagaatgcac

SEQ ID NO: 6729 - DNA, 291 bp, Zea mays
  misc_feature: Incyte ID No: 700352305H1
aagtgaggggccaaacctgtcatcagtgccggcagaaaactcttggtcatcatacaagctgctgtaaatgccagattgttcaagggcagttctgtggagattgtttgtatatgaggtatggtgagaatgtgttagaagttaagaagaatcctaactggatatgtccagtttgccgtggcatctgtaattgcagcatatgcagaaccaagaaaggatggttccctactggttctgcctataggaagtggttggacttgggtacaaatctgtggcacatttttaattgcgaca

SEQ ID NO: 6730 - DNA, 292 bp, Zea mays
  misc_feature: Incyte ID No: 700352306H1
gacgcggaggttggtgaaggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcacttgcgtatcctctgtatgcctctgttagagcaattgaaac

SEQ ID NO: 6731 - DNA, 291 bp, Zea mays
  misc_feature: Incyte ID No: 700352307H1
  unsure 17, 20: a, t, c, g, or other
agcccaccgaattcccngcnattcctctcccctcgcctcctcgtctccccctaggggatccgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggca

SEQ ID NO: 6732 - DNA, 290 bp, Zea mays
  misc_feature: Incyte ID No: 700352308H1
  unsure 157: a, t, c, g, or other
agggagtgggccaggcaaagtcggctcttgcgtcgacatcgacggggagaaacagctgtgggcaggcgatgaactgtagcgcgtgacagtgaggggatttggttggatccaatgtttggtcggtctgcttgcatcacctggttgcagctctgcattntctggctataaagcgacggggcccttgcgctgggcgcggagactggagagggcgagagtcctcccatccacaagttcttagcttttgcgagattgagatccggctggggacagaccgacagaggaaggtgaat

SEQ ID NO: 6733 - DNA, 290 bp, Zea mays
  misc_feature: Incyte ID No: 700352309H1
  unsure 3, 14, 103-104: a, t, c, g, or other
gcngacagcgaggnggctcccgtgcagcgaccttgccacctcgtcgtcttcggcaccctcttcccctccccgctcgctggcgccttcggctccccccaagaanncgttgattggtgcttctactggttctaccggaattgcgacgagcagtggtgctggtgcagcgatgagcaggagcaactggctgtcgaggtgggtcagctcctgctccgatgacgccaagacggcgtttgcggctgtgaccgtgccacttctctacgggtcgtccctggccgagccgaagtccatcc

SEQ ID NO: 6734 - DNA, 288 bp, Zea mays
  misc_feature: Incyte ID No: 700352310H1
gaactaggggcaagaccagatattgacagcaattatgcttttcattcttcctttggtactgctgagactattttggaagatatatcaagtatgaagatttccgatggtgaagatgagaacataacctgtcatctttcaaagagcttgggtgataaaaacttatacgttggaatgaatggacatacacatttgagtaattattttccaggagtccgtaacactgcattaagtactggtttaagtacaagagcatcccattttgttcataatgcaccaaaactacattca

SEQ ID NO: 6735 - DNA, 288 bp, Zea mays
  misc_feature: Incyte ID No: 700352311H1
  unsure 29: a, t, c, g, or other
aagggaacgtggaaaagtgagctccaaantttatttgtcatacatgggggaagcttacaaaggtacactgataccactaattatcttggctcaaaccatgttccaagttcttcagattgcgagcaactggtggatggcatgggcaaacccacaaacagaaggagatgctcccaagacagatagtgtggtccttctggttgtttatatgtcccttgcctttggaagttcactatttgtgttcatgagaagccttcttgtggctacctttggtttagcagctgcccagaa

SEQ ID NO: 6736 - DNA, 289 bp, Zea mays
  misc_feature: Incyte ID No: 700352312H1
  unsure 7, 43, 83, 188, 192, 269: a, t, c, g, or other
gacaganagctgaagagactgataaagatgtttcgtctttggntttccctattgaagagcatgaagaaaaatatgcagtgagncctatagctgttgaaaagagcgtcagtcgggaagccagtgcatgtgaatctgcaggaaaacccctaactgtcatcttttctaacgatctccacaccaaacatctncgcncatgattgtgatgtgctaattaaggagactggtgaagatgttttagctcaggagaattgtaatgaccagcctgttcnggcccagactgacctagaaa

SEQ ID NO: 6737 - DNA, 287 bp, Zea mays
  misc_feature: Incyte ID No: 700352315H1
  unsure 89-90: a, t, c, g, or other
ctgatacaagagctgagtggatcattgctgctcagggatgcttccgacaaaatttaacggttgtaacaatatatgcatctcttggtgannatgcattggtgcattcactaaatgagacacaggtttcaactctgatatgtgattcgaagcaacttaagaagatacctgcaatcagctctaaactgcagagtcttaggcgtattatctatattgaggatgaacctgtcgaggctgagacactgaaccaagtgaagcatttgacaacattgtctttcactgaagtagag

SEQ ID NO: 6738 - DNA, 163 bp, Zea mays
  misc_feature: Incyte ID No: 700352316H1
  unsure 32: a, t, c, g, or other
tatacgtacagttaatagcagctagctgttgnaagtggattgctatgcgttagtagcctatagtaggtaaaaggaggcactcactcatctcactataggctactatacgtacagttaatagcagctagctgttggtgtggattgctatgcgttagtacttgtt

SEQ ID NO: 6739 - DNA, 293 bp, Zea mays
  misc_feature: Incyte ID No: 700352319H1
  unsure 180: a, t, c, g, or other
gccaagaaggaaaagtagcggcggcatggggtcgcccaaggcggccaagagcatggtgaagcaacgcatctggcgtcaccggctcgtcgcgccgttcgctgccgttctcatcacggccgtcgtcgtattctccggcctgttcgcgcaggacccaagtgccacctcggagttcactgccgncaacgcgggtaacaccctgccagtgcgcgataagtcggaatccacagccagaggatctcccaacaaggaggatcttgcaacagtgcatttgagcaagaattggatgttggaaa

SEQ ID NO: 6740 - DNA, 288 bp, Zea mays
  misc_feature: Incyte ID No: 700352321H1
  unsure 6, 162, 184, 187, 221, 281, 283: a, t, c, g, or other
accaantccaccggtcttgcggccccatcttccgctccgacgatcccggggactttccagtaagtagcagcctcaagcaccaattcgtctctctgcctaagttaccaagggcaccccagttcgccgaggtggatcggtagcaaaaaccgatactggtacgtngccatggaggcagtttgatttngtngacctaacggccttccggatctcttgggagccanagcgatggcgcgcggcgtcgctttctccttgttctcgcgttgctcgccgcgctactcgcngncgtcc

SEQ ID NO: 6741 - DNA, 284 bp, Zea mays
  misc_feature: Incyte ID No: 700352325H1
  unsure 267: a, t, c, g, or other
aatggttttgcagaatctgctccggagagagcccttgaagcttgttgatgggggtcagtctcagagaacctttgtctacatcaaggatgctatcgaagctgtagtgctgatgattgtatgttgctgcgtttatctctggctccttgtttttatgcactaatccaatgaggctgaactcttgttgtcaattgcaaaaggaaaatcctgctcgagccaatggccacatcttcaatgttgggaatccgaacaatgaagttaccgttaggnagttggcccaaatgatg

SEQ ID NO: 6742 - DNA, 284 bp, Zea mays
  misc_feature: Incyte ID No: 700352326H1
  unsure 42, 116: a, t, c, g, or other
tgtcaagcagccaggctcaggggtaaggtttcagcaattcanctccctcgcctccgccgcggcaccggcactacgagtgcttcgctaccagccagccagcacactctacgagtcgncatcttccactccaccgaggcagctccaagccatggccatggagaaggccgcctccttcctctcctccctcttaggcggcggcggcggggagccggcggcgactgtgaaatctatcttcatataccctatcaagtcctgcaggggtcttgccgtgtcacaggcgccca

SEQ ID NO: 6743 - DNA, 285 bp, Zea mays
  misc_feature: Incyte ID No: 700352328H1
ataagaagcagaaatgcatacataaaagatatgcttaccagattgtgctaaaaaccttggatttgctgcgatcgatgccttcccttgttgatgtggatgttccaaacggtggacattttacagtttgcggtgatgtgcatggccagtactttgatttgctcaacatatttgacctcaatggccttccatcagaagaaaatccttacctcttcaatggcgattttgtggaccgaggatctttctccgttgaagtcatactcaccctttttgctttcaagtgcctct

SEQ ID NO: 6744 - DNA, 147 bp, Zea mays
  misc_feature: Incyte ID No: 700352330H1
  unsure 78: a, t, c, g, or other
agagaaggtaggtgaggttgctgccctacagaatcctttttaaaaatttgtcaccatcagatattctacctaatggancgaccccaaatagatccatagcagagactcagcagagactcacatcaggtcccctgtccttctgttcca

SEQ ID NO: 6745 - DNA, 285 bp, Zea mays
  misc_feature: Incyte ID No: 700352332H1
  unsure 30, 93-122, 248: a, t, c, g, or other
ccgcgtccagtgtgtccgctactccgctcnccctcagtcctcagttcctcacctagcggtaggtggcgcgcgggagacgtagatggcggcttnnnnnnnnnnnnnnnnnnnnnnnnnnnnnntgacgccgacagaggggacggtgatcgcgatccacagcctggaggagtggagcatccagatcgaggaggccatcagcgccaagaagctggtggtgattgacttcactgcaaatggtgtcctccgtnccgcgccatggctccaatttttgctgatatggccaga

SEQ ID NO: 6746 - DNA, 292 bp, Zea mays
  misc_feature: Incyte ID No: 700352333H1
caaagccgagcaaacaaaacgatatgccgctgccctgaaccgagaccaccaccgctctgcctcgccttcgcctcacctcacctcacctcgccgactagggttttgtaccgccgtggatctcgccgtccccgccatggacgtctcgcacgcgggatcctccgtcgccggcgaggctccgacgaccggggagcaccggatggggactaccatcgtcggggtctgctacgagggcggcgtcgtcctgggcgccgattccaggaccagcactggaatgtatgtagcaaccgtgctt

SEQ ID NO: 6747 - DNA, 291 bp, Zea mays
  misc_feature: Incyte ID No: 700352334H1
  unsure 47: a, t, c, g, or other
agttaatggcatagagtttgccagtggaggacctaagacaacttggngttctgttcgtgcagcaatgggacacccagaaccctttaagcttgattatgtttcaataggaaatcaagaatgttggatgctctactatagaggaaattaccaaaagttttactcagcgattaaatctgcctacccagacatcaacattatatcaagttgtgataggccaactatttcgccatccaaccctgccgatctttatgatgttcatgtctacacctcttcgactaatatgttttcaaa

SEQ ID NO: 6748 - DNA, 288 bp, Zea mays
  misc_feature: Incyte ID No: 700352335H1
  unsure 18, 42, 204: a, t, c, g, or other
tcttcctgcgacggaagnaaacactgcccgagacatagacancgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagacngaggacgacttaaagtctctgcagagtgtggggcaaataattggagaagtactccgacctcttgataatgaacgtttatcgtga

SEQ ID NO: 6749 - DNA, 283 bp, Zea mays
  misc_feature: Incyte ID No: 700352336H1
ggatgagagctctgcaaaggagtttagcttgcgtttactttgtgctgctgcaaatgtggggggtgtaattgggaagggtggtggaattatcaaacagattaggcaggagtctggggctttaatcaaagtggctagctccaattcagaccctgatgatgactgcataattacagtttctgcgaaagagttctttgaagatcctgtatctccaacaattgatgctgcagttcgtttgcagcctagatgcagcgagaaaagtgatttagaatcagctgagcagtca

SEQ ID NO: 6750 - DNA, 285 bp, Zea mays
  misc_feature: Incyte ID No: 700352337H1
ctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgag

SEQ ID NO: 6751 - DNA, 278 bp, Zea mays
  misc_feature: Incyte ID No: 700352338H1
  unsure 12, 186, 252, 274-275: a, t, c, g, or other
atgggcaaggantcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcangggaagatcaatgaagcttataagaagttgcaggatggatggctgaataattgggacaaagttccncctctgagtttctaaggtagcnnaag

SEQ ID NO: 6752 - DNA, 283 bp, Zea mays
  misc_feature: Incyte ID No: 700352340H1
  unsure 79, 147: a, t, c, g, or other
cagttttcggtatgcctatctaaagggttaggcgcacccatcggatcagttgttgttggttcagaggccttcatcgacnaggctagaattcttaggaagaccctaggcggtgggatgaggcaggttggagttctttgtgccgctgcntatgttgctgttcgtgacaccgtgggaaagcttgcggatgatcacaggaaggctaaagccttggcagagggcctgaagaaaattaaacagcttacggtggattcgtcttcagtcgagaccaatatggtgttcttcg

SEQ ID NO: 6753 - DNA, 280 bp, Zea mays
  misc_feature: Incyte ID No: 700352341H1
acctgggggcaaggtccttatcagtgactactgcaggagtcctgggaaaccatcagaggaatttgcagcgtacattaagcagagaggttatgacctacatgctgtggaggcttatggacagatgttgaagagtgctggttttcgtgatgtcattgctgaggatcgaactgatcagttccttggtgttttagataaggagttagctgaatttgaaaagaacaaggacgatttcctgtctgacttcacccaggaggactacgatgatatcgtgaacggttgg

SEQ ID NO: 6754 - DNA, 279 bp, Zea mays
  misc_feature: Incyte ID No: 700352342H1
tacaaatttgcttgccaatcttttccggtatgctgatttggagacacagtttgcatgcttcctgaagcaagctgctaatggcatcccgacctcttcattacctcgtattcgggatgaagcaacaaacacatgcataaatattcttcaatcttaccgcaaacactgtgcatctgtaacctcatcggggcagttgattctcccagaggctctaaaactgctgcctttatatactctggcactggtaaaaagtgtaggcttgagaactgatgggcgattaga

SEQ ID NO: 6755 - DNA, 281 bp, Zea mays
  misc_feature: Incyte ID No: 700352345H1
  unsure 55, 72, 109, 131, 183: a, t, c, g, or other
gtctcctaaaccctacacatctctctcggccacggtaattgccatcgccatggcngggaggcgcccggcacngacggccatcctccttctcctcgccgcggcattcgcncccatctcctccgccgttcgcncagtctccgacgcgcacagatccgctgccgtggagcttttcgccccctccgntgacggatccttcggcgatttggagagtacgtatgaggcggtgaggactttccagatactcgggctggagaactataagagtctgtctgggaaggcgt

SEQ ID NO: 6756 - DNA, 229 bp, Zea mays
  misc_feature: Incyte ID No: 700352346H1
  unsure 162: a, t, c, g, or other
tcatcagttcaccgcggatcagctcggtgctcgaagatgacagcttatgacctttgagaatgtctactaagaatcgccctttgtataatactactagatcctctcttttttgtattttctttcctaggactagcttccagtgttactgggctctctttcgtngtgtttctattatgactaagattagagagagaatgagagatggatccatctaaataaaggttccaga

SEQ ID NO: 6757 - DNA, 277 bp, Zea mays
  misc_feature: Incyte ID No: 700352348H1
  unsure 2: a, t, c, g, or other
tnttaaggttggtgatgactgtagacaagatgtgctggcgctgcaagtgattgctctattaagggatgtatttcaagctgtcggattaaacctgtatctttttccatatggtgttttgcctactggaccaggccgaggcataattgaggtggtcccagatactcgaagtagaaatcaaatgggtgaaacaactgatggtggtttattagagatatttcagcaagattatggtcctgtaaggtcacttctttgaaactgctcgagaaatgttatgaca

SEQ ID NO: 6758 - DNA, 303 bp, Zea mays
  misc_feature: Incyte ID No: 700352349H1
  unsure 164-165, 169, 179, 189-190, 200, 206, 209, 221, 262: a, t, c, g, or other
agatgcccttaaggaaggaatgggtggtggtggatcccatgctgatccatttgacattttctcatcattctttggaccctctttggaagaggtggtggaagcagcagggaagaaggcaaagaagggagaagtgtagtccacccatttaaagttcctctggaagnncttnacaatggatnctcaaagaanntctctcttcnggggantgncatctgctccangtgcaagggcaagggctcgaagtctggtgcttcatgaggtnccctgggttccaggctcagtatgaagtcacattcgcagcgg

SEQ ID NO: 6759 - DNA, 105 bp, Zea mays
  misc_feature: Incyte ID No: 700352350H1
  unsure 40: a, t, c, g, or other
ttgctgcagaaccaatatcggtggatttcacattactganttttctgaggcagcttctctgtctaaaatatccctatcacacggcaagtatttcatgggaaaagg

SEQ ID NO: 6760 - DNA, 293 bp, Zea mays
  misc_feature: Incyte ID No: 700352352H1
  unsure 250, 262, 282: a, t, c, g, or other
gggatctggaagtcatgtccgcaatctggtgggcctgttcagtttccaggattcaacggggaattaatttgtccgatgtatcatgagttgtgtactactgtaccagttccaatgactggccaatgtccaaagtcatgcagttttaacggtgactgcattgatggaacctgtcactgctttcctggttttcatggccatgactgcagcagaagatcttgcccagacaagtgcagtaaccatggtacatgcnaagctagtgggntcgtgaatgcaaaggggtgncggtttcctcc

SEQ ID NO: 6761 - DNA, 248 bp, Zea mays
  misc_feature: Incyte ID No: 700352353H1
  unsure 153, 179-180, 187, 204, 209-210, 221, 223, 234, 239: a, t, c, g, or other
tcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggntgctccatgcggtttaccgtgttggnnatctggnccgcacaatcagtactncgcgnntgcttgggatnanctgctgagaanagggntttcctaat

SEQ ID NO: 6762 - DNA, 291 bp, Zea mays
  misc_feature: Incyte ID No: 700352354H1
  unsure 3, 160, 223, 229, 247, 259, 265-266, 272, 279, 288: a, t, c, g, or other
gantggtcgcgtcgggcgttaagcattaaaacggaagaaataagcaaaccaaacatgcgtgattcttcgtttacattgacgttaccgtggttcatttaatttactgcacagaaaatctaaagacgccagttcccaacattatgcatgaagggaactagtnctggtgaaggccggagattgatattctggatcagctacttgtcattgctgacccccgcaaaanggggcnccgtcgtcttgtaagccncccatgggaacnctattnnggggtnctctacntcttgttcnggg

SEQ ID NO: 6763 - DNA, 295 bp, Zea mays
  misc_feature: Incyte ID No: 700352356H1
  unsure 23, 260: a, t, c, g, or other
aggttttgaacatcatcaatacnctttgctcagatagtagaaacatcgtttttcttgtcagtggtagagacaaagatatgttaggaaagtggttctcctcatgtccaaaattggggattgcagctgaacatggttacttcttgaggtggtctagcgaagaagagtggcaaacatgcactcaggccatggactttggatggatgcaaatggcaaagccagtgatgaatttgtatacagaagcaactgatggatcctacatngagacaaagaaagtgccttggtgtggcccatcagg

SEQ ID NO: 6764 - DNA, 291 bp, Zea mays
  misc_feature: Incyte ID No: 700352357H1
  unsure 231, 275, 289-290: a, t, c, g, or other
gcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgctccaaagtacgattgggtgcccgtttggcgagggatgtcattttctgcactttgtccctggtggttacccggcanttgcaaaaatgctgaatctaatagctctgtgtatctgcccaatnaagaactctggggnnt

SEQ ID NO: 6765 - DNA, 296 bp, Zea mays
  misc_feature: Incyte ID No: 700352358H1
  unsure 34, 36, 51, 180, 265, 277, 280, 292: a, t, c, g, or other
ggccaggccatgtcgaggttctggaagccagggncncgcgaagccgagcanccctactcgtacgacgacgaggagggcggagtcgtcttcctgccctcctccagctccgtctcctcctccggctttggttacgcgagtctagagagacagcggcaacggctgccggtgtacaagtaccgnaaagccattctctacctggtggagcggcacgccaccaccattgtcgtcggtgagactggcagcggcaagtcgacgcagttggttnagtactgaatgnggnttgtgggctgantttg

SEQ ID NO: 6766 - DNA, 299 bp, Zea mays
  misc_feature: Incyte ID No: 700352359H1
  unsure 73: a, t, c, g, or other
ccccctccgaatccgagggttcaagcgaccgacggcgaacatggcggcggacggcggcccagcgacgtcggcnctggaagaggccctcaagcccttccaggaaagagcctccgaggctgagatacgcatagcgaactggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagta

SEQ ID NO: 6767 - DNA, 276 bp, Zea mays
  misc_feature: Incyte ID No: 700352360H1
gacttaagcttgagacacggcttcaagttcttgagggtagagaacttgggaaatctgctggttccacaaaggggaagcccaagatagaagtgtatgaaaaggaccggaagcagggtgctggggctttaacaactcctgctaagacatacaaccctgcagctgatctggtacttactgaagaaacaccaaagaagtcagaattggcttcaaagaagaggaaacatcatgaggttcaaactgaaccatcggcagagcttgcagagggagcagtccagg

SEQ ID NO: 6768 - DNA, 296 bp, Zea mays
  misc_feature: Incyte ID No: 700352361H1
  unsure 62, 67, 72, 78, 118, 155, 159, 164, 167, 205, 214, 225, 233-234, 261,: a, t, c, g, or other
atgggctgcaaaaaacggatccgtctagaccatggcatggaatgaagcttcctattcagcancaagnaactnactggnggagatcactagcctagccttcaaactcgtcgaagtcttngaactcctagagatctgctccggcagcttcatctgancaanggttncancgagggcaaccttgtgtctatataaaaagcaaagtgantattacgcnccgggtatccnagtggcgnnaccaacacaatgcttgaaaaaggttgntgcctcgnnggtaatggtcccaantttttgggtng

SEQ ID NO: 6769 - DNA, 92 bp, Zea mays
  misc_feature: Incyte ID No: 700352362H1
  unsure 3, 6, 8, 11-12, 26, 68: a, t, c, g, or other
cgngangnacnnatccgatcaccacntcggcgccgcgctccgaaccccaacccaaccgcgctgtctancctcctcctccctgtccacacaac

SEQ ID NO: 6770 - DNA, 185 bp, Zea mays
  misc_feature: Incyte ID No: 700352365H1
  unsure 13, 28, 108, 146, 159, 161, 174, 178: a, t, c, g, or other
aggcgagccaganagagaaggccaagangcttcctctccccattcctcccttccgtaccctagccgagccagccgcgaggaaggaggcatcccgccgtctcgcctggngcccgcccgtcggccgaccttctgccgcagttccaatngtaaaaagatctngntttttgtgaaagngcgngtggata

SEQ ID NO: 6771 - DNA, 244 bp, Zea mays
  misc_feature: Incyte ID No: 700352366H1
  unsure 137, 221-222, 227, 231-232, 234, 236: a, t, c, g, or other
atatttcttccccgtagaaacggtgtttttcaaacaataagttctgaagaacctcgtgaagatgtaaagtgtggtccagttgacagggtgggattttcaaattcatcagaaccaaatgcgagtgtccgcaatgaganttatgttcctagaatgcgcaaaccaggagacaactgctatatcgaagtttcaagagccgggagagcaaggtcaagtgtctctanngggangggnngncncccccccc

SEQ ID NO: 6772 - DNA, 282 bp, Zea mays
  misc_feature: Incyte ID No: 700352373H1
  unsure 38, 223, 236, 242-243, 246, 276: a, t, c, g, or other
agggagtgagtcgagatccattcccaactgcacctgcncgcctcgactggtagcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagncgtcgccgtctcntcgacnntanaaccagggatccggatgttatgatgttcanttatga

SEQ ID NO: 6773 - DNA, 298 bp, Zea mays
  misc_feature: Incyte ID No: 700352377H1
  unsure 35: a, t, c, g, or other
gactccagagccgcctcttcgccctctcgccatcngcaggctacggtggctgcttccccgagcctgcaggtagaccaccttgtgttgattcctcgagtcttcacctggtgcttccgtttgcagcttcatttttaactaagatgtcacaagccaaggaagtgaggtacactgcacggtctattacacctcctgctgatagaaatggcacttcaaggtcgcctcctccaaagagacgcagcccttcaaggtcacctccacctaagagtgcttcacggtccccacgtccaaggagtccaaa

SEQ ID NO: 6774 - DNA, 301 bp, Zea mays
  misc_feature: Incyte ID No: 700352379H1
  unsure 66, 207, 275, 287, 291: a, t, c, g, or other
gcaggtgctgaggaaactgagagctggaggtggtttttgaccacagtaaggtctcttcctcagtcngctgaacctgaaacttaccagatgattcaggatgaaatggtcagtgccatgcgtgatgataggagcttgggttgttctgaacttagcagatggctaacaatggcacaaataatggcctccagctttggcgagaagagtctntctttggagcactggcagatggtgaaggagcttgagaggcttagaaagcagaggatgcatgagaatgncccatcattagntgtnttttccatct

SEQ ID NO: 6775 - DNA, 310 bp, Zea mays
  misc_feature: Incyte ID No: 700352380H1
  unsure 191, 239, 257, 280-282, 284, 287: a, t, c, g, or other
agagcccgatcccgatccagcgaggcggcgaccctccctcctccccttgcttcgctcgtccagccctgaccacccgcatccccgtcagtcatggcagcggcagaggcggaggcgcggtgcgtgcgctgtcccagaaggagcaggacatacagatgatgctcgccgccgacgtccaccttggcaccaagaantgcgatttccagatggagcgctatgcctttaagcgccgcaccgacggnatctacatcatcaacttngcaagacattggagaaactgcannntncancgaggggtttcgttgccatcgag

SEQ ID NO: 6776 - DNA, 238 bp, Zea mays
  misc_feature: Incyte ID No: 700352382H1
  unsure 42, 62, 111, 164, 216-217, 220, 226, 235, 237: a, t, c, g, or other
ttacagataccgtgctgctgtgctgatggacaaccacaaganagaaagaggcgatcgcggantgaccaaggccatcgccttcaaggcggacctgaacctgctccacctgcncgcggccttccacgagcacgtgggcgacgtctcgagcgccctccaggactgcngcgcggccctctcggtggaccccaaccaccaggagatgctggagttcaccannggntgaacngcgaaaccncng

SEQ ID NO: 6777 - DNA, 285 bp, Zea mays
  misc_feature: Incyte ID No: 700352383H1
  unsure 38, 136, 211, 268, 274, 280: a, t, c, g, or other
aagacatgcgaagtgtagtttcttctagtgaaggtcantgtagtgtgagggcaaccaagaagacatcttcctctgtcaaaactggcaggcctttcagctgctgctttacctaccgtgcttgctagttgtgatacanagttggtgcctgtggatacagcaatggatataggtctattcgacctcttctcaggcaacagttatggacgcgaanggaagtcagttgggtttgactacaaggctaattgttaatgagattgccctgatgaangagatncgtttnggagc

SEQ ID NO: 6778 - DNA, 283 bp, Zea mays
  misc_feature: Incyte ID No: 700352385H1
  unsure 107, 282: a, t, c, g, or other
gccgttgctaccgccccgtacctcgcttgctttcccgtcgccgaaatgacgaagcgcaccaagaaggctggaattgttggcaaatatggaaccaggtatggcgctanttgcgtaacaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacatgctatgcatcatgtcagagcnc

SEQ ID NO: 6779 - DNA, 292 bp, Zea mays
  misc_feature: Incyte ID No: 700352387H1
  unsure 43, 122-123, 163, 166: a, t, c, g, or other
gtggaggatggtctcccaagataacagcagcaaaggctcaatntacgttcctcgatctatgttgtcaactcacaaagaagaacccgaggatgataaatctccaagattggattcaagttcannggaggatgcccagattgtctccagtgcatccaactttcanacnccaggattttatgctggagaggtttcaacagagtgttgcttcttcgcctgatagttcatcttctaatccttcaaatagcaacactggtgattctatgcctgtatattctgacataaattgttaaag

SEQ ID NO: 6780 - DNA, 260 bp, Zea mays
  misc_feature: Incyte ID No: 700352388H1
  unsure 19, 34, 199-200, 215, 219-220, 223, 233, 235, 246, 255, 259: a, t, c, g, or other
gcgaccaaagaaaaggacncagcaactcagcaanacccccatcttccatagctctagctactagctactagtttcaggcctgcggctcgtgaacacctcatctttttagccacttttgccaccaccgacgacgaccgatcgatcagctagcagctaggccatcccgcgcgcgtcacgaggaacccacggccggcgtcgnnttgttgtcgtgtaanttgnnagnttccctagcntnggccttttccnttctttgcngggng

SEQ ID NO: 6781 - DNA, 141 bp, Zea mays
  misc_feature: Incyte ID No: 700352389H1
  unsure 16, 73: a, t, c, g, or other
accagacgcgccaggntttcaggcttccacgaatctccccgccgccctcaattcccctcggcgccgccgcctncctcccctcgcttcggtcctcggttagttaaccatccaggttctgtcaagatgtctgatagccatgag

SEQ ID NO: 6782 - DNA, 289 bp, Zea mays
  misc_feature: Incyte ID No: 700352391H1
  unsure 125, 183, 229, 286-287: a, t, c, g, or other
ggaagaggtattacctaaactatgtcagagacatcttctaaatgcttaacatatggactgaaaacttctcagttctctaaagagatttatgaaaccatcttatttgtctatatctatcgtgaganagaattagtacacaacggtgtacaaagcacacatatctttaggatctccaagtttgangtttatttcctttgtctctgcttcattgcaaaacttattgtatcanaattcttatctggtattgccttattgctggatgctggatctcctatcgtagaacagnntt

SEQ ID NO: 6783 - DNA, 291 bp, Zea mays
  misc_feature: Incyte ID No: 700352392H1
  unsure 290: a, t, c, g, or other
ccaaagcagcccagcaggtaacgccgacgagcccgccagcggctgcctcctcaccgtgggcatgcaggtgctcgctagcgctgtgccctcggctaagctgaacctctcgagcgtgaccgcgatcaacagccacgtctgcaacgccgtccaccagatcacagccgcgctcaagggcgctggggcgagcggggccgctgaaccggcggctgctgcctccgagtagtagcaagagcgggagcagaggagagcagatccatacaccacaacaaaagccaattgccttccagtcng

SEQ ID NO: 6784 - DNA, 81 bp, Zea mays
  misc_feature: Incyte ID No: 700352396H1
  unsure 12, 30-31, 44, 52, 57, 67-68, 70: a, t, c, g, or other
attaaccctcgntcctgtcgcgcagcagcnncctccatttcatntctccgcnggcgnaggcgtggannanttgaataacgg

SEQ ID NO: 6785 - DNA, 295 bp, Zea mays
  misc_feature: Incyte ID No: 700352401H1
  unsure 146, 194, 198, 215, 230, 291-292: a, t, c, g, or other
aggctcctgcatccgatgataagaaggatgataaagagtgaaggttgaaggcaaacaagggtcaaatggatgccattccattcatttcgtttccaaggttcagcttccccgcaaattttcattgtgttttctccgagatgaatgtntgtgttcggtgaaatcagagtcgtcagtccatctacatagctttcctnggtngatagacctgtaatttnaagtcgcatgttaanctgggatgcctggggccagcagtttgaacattaatttggatggctttgggatgacgcgttnnata

SEQ ID NO: 6786 - DNA, 212 bp, Zea mays
  misc_feature: Incyte ID No: 700352403H1
  unsure 52: a, t, c, g, or other
gttatcaaatgtatcagaggaggtttatggaaaatatcccatgtcgcttgtntggctgcctttcaggctgacgtgctcccattctgctcctcatttcctttcacatgttcgtcatgtaaatgccaatactaaagtgtcactgcatgggcagaagtgttaccaaagtgttgattgtgctcttatcatttgattaagcccctgcttaagttctc

SEQ ID NO: 6787 - DNA, 293 bp, Zea mays
  misc_feature: Incyte ID No: 700352405H1
ctcacggttagcggtgcctacaagagtgcccgaacaaagacacaactccattgccgtgttgaccgctctgggcttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagcgcgactatgatacctccttcagttcttggtcgtggcattggttggcagggcatcggtactttact

SEQ ID NO: 6788 - DNA, 296 bp, Zea mays
  misc_feature: Incyte ID No: 700352406H1
  unsure 54: a, t, c, g, or other
ggagtctgagctcgccgctttagcgagcgcaagcagagcctgccaaaaggctanagaaaaaaaaatccgccttctcctcccagtcgcaggccaggctcagcctcccctctcccctcctcggcatcttcgccgccggcgatctatctctctcacaatggcggcgcccatgtcagccatcgactcagcgtggcagctcctgatcgccaacttcaccgagttccagctcgccaccgtcgtcaccttcctgctccacgagaccgtcttcttcctctccggcctcccctccctcctcttcg

SEQ ID NO: 6789 - DNA, 289 bp, Zea mays
  misc_feature: Incyte ID No: 700352408H1
  unsure 12, 16, 27, 41, 57, 60, 82-83, 100, 110, 124, 127, 137, 144, 155, 161, 165,: a, t, c, g, or other
ccaatcatggtnaagnaatcaaacaantcctccgtgaaagncttcgcaacaccagtncancggtcatccagcatggtgcatnnttggggcttgggcttgnagctttgggnacatcagatgaggncanatatgagganataaagnatgtcctctanacaganagtnctgntgctggtgnggcagctngtantggcatgggctnctcaggttaggaccgctagtgaaaaggctagtgagangcnngcttatgcacatgatacacngcatgnnaagatnatagggggttgtc

SEQ ID NO: 6790 - DNA, 273 bp, Zea mays
  misc_feature: Incyte ID No: 700352409H1
  unsure 48, 57: a, t, c, g, or other
cttaatgctgttgccctagacgtcattgcttcaataccatggtgttgnatacagcanctcgtgaaagcataaagttcataaaagcttcttctgcccgtgaagagaagtttgctgagattgctctgcagctggagattcccagtaccaagaccctctgtctggatgttacaacccagtggaacaccacttatctgatgctgctggctgctttggattataagcagactttcactacactagaaacatgtgatgacaactacaatgaagctccat

SEQ ID NO: 6791 - DNA, 294 bp, Zea mays
  misc_feature: Incyte ID No: 700352412H1
  unsure 46: a, t, c, g, or other
ggagaccttgattaaaaattgtggtgattttgttcatatgcaagtngctgagaaggatatgcttcatgaaatggtgaagatagctaagaagaagcctgactatcacgtcaaagagaagatattaattctgatagacacttggcaagaagcttttggtggtgcccgtgcaagatatccccagtattacgcagcatatcaagagatgctgcgtgctggagctgtatttcctcaaaggccggagagtactgtgccaatctatactcctccacagacacagcctctacggaactatcc

SEQ ID NO: 6792 - DNA, 294 bp, Zea mays
  misc_feature: Incyte ID No: 700352413H1
  unsure 7, 62, 68, 195: a, t, c, g, or other
gcgagcncagggcaacagcctccacggcgacgagagaatggggagaggagggatcggaggcncggcgnccatggccatggccatggagaccgccgatcctgcccgtgcattcgtgaaggacgtcaagcgaatcattatcaaggtgggcacggctgttgtcactggcatgaatggccgattggccatggggaggcncggttctctctgtgaacaggtgaagcaactgaattttcaagggtatgaggtgattctggtaacctcaggagctgttggtgttgggaggcagaggctcca

SEQ ID NO: 6793 - DNA, 294 bp, Zea mays
  misc_feature: Incyte ID No: 700352416H1
  unsure 158: a, t, c, g, or other
cagcaacacctgatgagatacaaaaaaacctatcagtatgatgctgtgtttgctcttggcttcgtcactgtctatgatcagctcatggaagggtaccccagcaatgaggacaaggattccatcttcaaggcatatataacagcattaaatgaagatcnggctcaatacagagctgatgcactaaagatggaagagtgggcacgttcccagaacggtagttccttagttgatttttcttccagagatggagaaatcgaggctattctgaaagatatatcagaaagggccaagggt

SEQ ID NO: 6794 - DNA, 285 bp, Zea mays
  misc_feature: Incyte ID No: 700352417H1
  unsure 269, 279: a, t, c, g, or other
cgatcccagcatccgagagagctccacaggccagagtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtanctgtgccacnattgag

SEQ ID NO: 6795 - DNA, 287 bp, Zea mays
  misc_feature: Incyte ID No: 700352418H1
  unsure 109, 131-132, 138, 147, 157, 218, 220, 268-269: a, t, c, g, or other
ctagctagcatgtacgccgttccccaacctctggcgtagtcttgttcatcttcgatctcctccatctcccttcatcctctctctcgctgtttgaggagaactgcctgcncctgctccctcttccgtcctcnncgcgcnccgctcganatccccaganttcatttcaggccgggatggacgactacgcccgggagatgatggagctcaagacgctcgtnanccgcaccctcgagaagaagggcgtcctcgcaaagattagggtgagtannagcaacgtgtttgaagca

SEQ ID NO: 6796 - DNA, 280 bp, Zea mays
  misc_feature: Incyte ID No: 700352419H1
  unsure 20, 165: a, t, c, g, or other
cgagtccaaatccgctcgtntcccctcgaagtcactccctccagccctcaccggctccgcgtcctccggctctcccacccgagccgagaccacccatccaagcgcgcgcagttccggaagcgacagggccggacgagcgcctcccaaatttagcagccgcggagncgtgggcgtgggtccgtaagagggtcgatggggtactgccgtccctgagcagcaaggcggcgcacttcgtgtccgacctcaccaccgtcatcctcagccccgtctccgagcgcga

SEQ ID NO: 6797 - DNA, 283 bp, Zea mays
  misc_feature: Incyte ID No: 700352421H1
  unsure 11, 28, 168, 224: a, t, c, g, or other
tctcgcctgcncttccgcctcccgagtngcgccgccgtctccatctccacccctccatcctccgcggcgcccctgcactacggccatcgcactcccctcgctagcccttttctctgtccccaccttgcccgcgcatctccgtgcggccgtagcggtttcttcgtggantgcggcccgatcaccggcgggttcgcgtaattcagatggctgctgcctcctccgcnacttcgtccacgacttcacgtcaaggatgctagcgggaaaatgtggacttagcacctat

SEQ ID NO: 6798 - DNA, 229 bp, Zea mays
  misc_feature: Incyte ID No: 700352423H1
gtagcgcagaggtgagatttgtaacctgtaataagtgacttgtggcgctgaagatcgaaagtcagagaaatcttgtggatacaagctccacctccaaggaatgataatggaccctcgtcctcgtgacgatcccaacctcggtgctcgattgcccaccccaaatccacccgcacctcacatgattagcttctccctccagcagccacagcttcagttcttcccttcgtat

SEQ ID NO: 6799 - DNA, 282 bp, Zea mays
  misc_feature: Incyte ID No: 700352425H1
  unsure 161: a, t, c, g, or other
cgttcattgcggcaggccggcagccaaatcgagatctcgcccgtgctgaatcccaccactctcgccgacccggccgcagcaagcgcaggcattcgacaggagccgaagaaccgaagaggagatggcgtcggcgctgtcctccctgcgctacggcgacagcntctccggtggtgggcatctccgccgcgacggccgtgctctgcgaggccatgtcctggctcctcatctaccgcaccgccacctacaactccctccgcgcctccatcgagcgccactcccgca

SEQ ID NO: 6800 - DNA, 289 bp, Zea mays
  misc_feature: Incyte ID No: 700352426H1
ccgcagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaag

SEQ ID NO: 6801 - DNA, 287 bp, Zea mays
  misc_feature: Incyte ID No: 700352427H1
  unsure 2, 69: a, t, c, g, or other
gngaaggaggcatcggacgtcggatgcatgacacactcattgcattagcgcctacgcctaccgcaagtngaagcctatggatctcaagcaagcctcctctggtacaatcttctgccttctgcttctattctgcgtgggctgcagatgtcggccttcggaaatagaggccacccagacagcagccctcaaggttgatgcctcgccacagcttgcccggaagatccctgaaacactgtttgggatattttttgaggagatcaaccatgcaggagctggtggcatatggg

SEQ ID NO: 6802 - DNA, 289 bp, Zea mays
  misc_feature: Incyte ID No: 700352428H1
  unsure 22-23, 43, 90: a, t, c, g, or other
ctttcttcgacgcgcccccggnnatggcgaaccgcagtgttgncatgggcgtggccgtcgcgttcgtggccatgaccgcgctctgttgcncgcacgggcgccgcggagttgcccaggctggaccacccggccaggagtgacggatcgctgaagctgctcgtcgtcggggactggggacgcaaggggactcacaaccagtcccgggtcgccgaccaggtaagtaacggcagcgccatcttatacattcctagttccgaacttccgattactgcaagttagtgtgttcaaa

SEQ ID NO: 6803 - DNA, 286 bp, Zea mays
  misc_feature: Incyte ID No: 700352430H1
agatggaggcgagggacggggtagtgtgggagcagcgcccccaggacgtggacgcggagggcggcgacgggagctcactagcccaggtttcagcttctccgccgcggggctgctcttcccctaccacctcggcgccgcgcagtgcctcatggaccgcggatacatcacctgatcgcatctgggaacacaatgcaagatgctctgcaggtgaccaaagttctagctgacaactgccgaagtaaaggcacggcgtttcgccttggggctgtactcaaggatgtccttg

SEQ ID NO: 6804 - DNA, 287 bp, Zea mays
  misc_feature: Incyte ID No: 700352431H1
  unsure 7, 28, 33, 36, 55, 57, 62, 68, 107, 150, 155, 215, 238: a, t, c, g, or other
gaaagtntacaactatatcttgatacanctgtngancagcttaaagttgctacananctttncctttngcaggaagccttccgatccgtggaagatatccatggtcngatgagcatggtgaagaaaatgccaaaaccttctatcttggtngacantatgcaaagctgaccgaaatcttctgggtatctgatagccacctttatcatgcgtatgcntggctcaagcttttcaacctgcnaaagaactacaataaaaacttgtctcagaaggatctacaattaatagca

SEQ ID NO: 6805 - DNA, 283 bp, Zea mays
  misc_feature: Incyte ID No: 700352433H1
  unsure 47, 206: a, t, c, g, or other
agacacacttggggcatcttatgaccgttacttgcgcaatgggatgncctccgtcggtgcaaatgacacttctagggctgccgggatgggtgctggattggctgcagggatgactgcagggatgggtgctggaatggctgcagggatggctggctatggtgttgatggtcagcgtatgatgggtgttgttggtatggacagcaganggatgggatatggtggcagacctgagccacctcttccgcctgatgcatcaagcactctatatattgagggcttactg

SEQ ID NO: 6806 - DNA, 284 bp, Zea mays
  misc_feature: Incyte ID No: 700352435H1
agccctcagttccagaacctatgcagtatcagatgcgacacatggctcctgtgtacggtagcatgggacttccaggaatgcctgtgccagcaatacctggcagcatgtacggttccagagaagaaaaaggaaacgaagggtttactttcaaagctgcacctttggaccgatcagctaacttatgttacagtagtgctggtaacttagtgatgggtccatgagtgcctcttctgatggctatacctccatgaatcacacctatcaccgtcgtcatgaagttctct

SEQ ID NO: 6807 - DNA, 287 bp, Zea mays
  misc_feature: Incyte ID No: 700352436H1
  unsure 8-9, 11: a, t, c, g, or other
cgaaccannanacgcccattccccttcgccctcttcgaccctagcaagaaggcggcggcggagatggtgtactacgcgcttttggtgggcgcagagctggacggcctcaccaacctgcagcccagcggcggctgcgaacgaccccagcttcccctactacctcaagtgcaagctttgtgggagagatggaacaattgtgatgattcctggtcaggggacgccacttactattgagcagagccagaaagaagagaagacttgtttgatggtgtttgactgtagaggtt

SEQ ID NO: 6808 - DNA, 285 bp, Zea mays
  misc_feature: Incyte ID No: 700352437H1
  unsure 2, 163, 165, 233: a, t, c, g, or other
cnggcggctgccgaacctctgctccggcgactaggttcccgcctccccgactctgccccaagcgagcgcggcacggtgtcgccttggcttcctctcttctgcttcagtctcgcgccgccggtttctatcctgccgtcgcccggagctcatcgtgctgacctcnanctgacgcgctgaagggatctgggaacttcgaggatgctttgctgtgctggccaccaggcgtcccttcncctcttcgctctgctctctgtctcctcccttctgctcgtcgacggatcccat

SEQ ID NO: 6809 - DNA, 281 bp, Zea mays
  misc_feature: Incyte ID No: 700352439H1
  unsure 134: a, t, c, g, or other
cacctcttggctcttgcctcctgcatctctagagaggcacatcccagctccaagcttcgcgccttgttggatcgtggcgtccaagcaacggtggtagcggaggcgaggcagtggccgcagaaggaagcgcgaanatccatggaccaacgccaggtggttagcgagaattatgccaatcccataacatgcttcttccatgtgctattcaaggcgggggcgctagcttctacatcctattctcgctctttgtgaagagcttcgtcatcatcttcgtgatcacg

SEQ ID NO: 6810 - DNA, 284 bp, Zea mays
  misc_feature: Incyte ID No: 700352440H1
  unsure 46, 50-51: a, t, c, g, or other
cacggactaccgtctcctctcctttcctctcctgcaactgcaagcnaccnnccctccacccccatccacccacccgcccgccgacgcttggatcccctcccttgtttgccgtgtccccgcccaaaccccgtagccgccgccacagcaatcgctgccgccgccgctggaggccgggccgtgggggctgaaatgaaggaggtggtgctccacgtgtatgacgtgaccaacagtgactccgagaagacgaacaacaccatcctccagatcaaccgcatcttcaagga

SEQ ID NO: 6811 - DNA, 283 bp, Zea mays
  misc_feature: Incyte ID No: 700352442H1
ataggtcctcgacacagttcagcagagatgctggctctatgcccaaggtgtggacaggaaaggaggacataaaagccataactaaaactgttcgctcagttgtacgccagatgctaatatttaatactctatatatagaatactgttgaagacgcttctaaagcactagagtattgtagcactgatggaaggccttcgatgaaatgtttccctgaaagttgcatactacatcgctgaagcactacaatattgtaacactgagggaaggcctttgtatcatgac

SEQ ID NO: 6812 - DNA, 283 bp, Zea mays
  misc_feature: Incyte ID No: 700352443H1
atcattatttaactaggaatacgctgcctgctgtgatgtcacaacttggccctatttaatggccttgtgtgtgcgttgccgtcgtctactttcctttctcgctcgctccttccttgcaaccatatatcgaaaacccatctgccttcttcttcgcgagatccagggagaaactgaacactgcacgccatgaggtgctcagacggatcgatcaagcagcagtagcaagcgcggttgtgcatcatgcatgcatgcttgttcttcttttcttttgatttgttgctgg

SEQ ID NO: 6813 - DNA, 283 bp, Zea mays
  misc_feature: Incyte ID No: 700352446H1
  unsure 22, 62, 101, 186, 235: a, t, c, g, or other
cccgtttctgtcacaaatcgcnactaaaaccctagccttccgccatggccacctcccctgcngcctcgtcctcctccgctccgaccgcctccgcggtggcnccggctacgatggctgttgaggccaccgacgggccggtgctcagcgtagtatcgaagcgtctccgcgcactgcggaagaagtacnaccgaatcacgcagatggaggagtcgctcgccgccggcaagacgctcanccgagagcaggaggaggttctccgctccaagcccgtcgtcgccgctct

SEQ ID NO: 6814 - DNA, 133 bp, Zea mays
  misc_feature: Incyte ID No: 700352447H1
  unsure 44, 61, 132: a, t, c, g, or other
cttgattttacttacaacaccaatcatcatttccataaccaacntaccaaaacttattgantttccgtcatatgctgcttcatcaattaaattctcattcctccttagcctcttacctttactactattctng

SEQ ID NO: 6815 - DNA, 284 bp, Zea mays
  misc_feature: Incyte ID No: 700352448H1
  unsure 16: a, t, c, g, or other
ccaaaccctaattgcnacctccgttcccccaaaaccctacggccatggacggcggaggcggtggtgtagggggaggcggagttggggcaggtgtcatggtgggcggcggagtcgggccgggcggcggcgttggcggcgacgtggagctcgtcagcaagacgctgcagttcgagcacaagctgttctacttcgatctgaaggagaacccgcgggggaggtacctcaagatctccgagaagacctcggccacgcgctccaccatcatcgtccccgtcgacggcgtg

SEQ ID NO: 6816 - DNA, 279 bp, Zea mays
  misc_feature: Incyte ID No: 700352449H1
  unsure 41, 96, 104, 128, 134, 149, 154, 158, 179-180, 186, 196-197, 200, 203, 209,: a, t, c, g, or other
ctcctcgcgccccaaacccagagaacagtgctcgcgccaancccgtcgcgctcgcgccgcacctccgtcaggatgcgcgcctctgctgctgcgccngcggagcnaagaagaccgtctgggtgtggacngagaanccggaagttattaanggggntttnaaaaagggggggaaatttttnnctgggnaaaaaaaggnntgnggntgtttngngncccggngttttnnnnnttgggntggngtttntgtttcnntnggttngggttttggtnttggntcgg

SEQ ID NO: 6817 - DNA, 315 bp, Zea mays
  misc_feature: Incyte ID No: 700352450H1
  unsure 308, 311: a, t, c, g, or other
aacgagagcaagaaagtatcaaaacccgagagcaatggaggcggtggggaagagcgtgtgcgtgaccggcgcgggcggcttcatcgcgtcatgtctggtgaagctcctcctctgccggggccaatacaaggtccgcggcaccgtgcgcgaccctggtgctagcaagaatgctcatctcaaggtgctggaaggggctggggaaaggttgcagcttgtcaaggctgatttgttggactacagcagtgttgcatcagcaattgccggcttctagggtgtcttccatgtagctagccctgtcccttccggtnggncctc

SEQ ID NO: 6818 - DNA, 310 bp, Zea mays
  misc_feature: Incyte ID No: 700352451H1
atttcaggttattactgaagcagctggtcaccatggaggtgatacagtggacaagtctgtgggaattcttcaaggaggaatatgagaaggagaaggatcttgggggagctttgggtgccaaagcttcagaagatttgaggctgaggattatcgaacataatatcttggttgtatccaagtactatgcaagggttaccctcaagaggcttgccgatcttctttgcctgactttgcaggaggcagagaagcatctctcagacatggttaactcgaaatctctagtggcaaagatcgacaggccgatgggatt

SEQ ID NO: 6819 - DNA, 305 bp, Zea mays
  misc_feature: Incyte ID No: 700352452H1
  unsure 112, 220, 234, 241, 245, 250, 254, 258-259, 262, 275, 278, 285, 287,: a, t, c, g, or other
cgaggattttgatttcgcagaactggatgatgtgctgcgctactaccctcagggctaccatggtgtggaccgcgaaggccggcccgtgtacattgagaggctagggaaggtngatcccaacaaactcatgcagatcacgtctgtggatcgctacatcaagtaccatgtccaggagtttgagaaagccttcagggagaggttcccctgcttgcacattggntgcaaaggggcacntttacgngacnaagantttntggnnggngggggtttggggnttngggtttncngnnggtgngggggggngg

SEQ ID NO: 6820 - DNA, 308 bp, Zea mays
  misc_feature: Incyte ID No: 700352453H1
  unsure 22, 83, 98-99, 223, 227, 237, 243-244, 246, 249, 262-263, 265, 270,: a, t, c, g, or other
aaagaagaaaggcatagcagcnggcagcggcatgggcaccagccccgtcatccctgcgacgatgctcttcgtcgctcttcttntcgctgtctgcttcnncgccaccgccgccaggtccagccacgcccgccacaccgacgccgacgacgcgattcgtctccccagcagctttggcgctggtggtcgaaccgtggaatttgttggaattccgttttaaggaggnctcnttccggggtngggttnnanaangtgttggaaaatnntnccccntnnnnngntntgnnnnntcncngnnngnngtgnttttt

SEQ ID NO: 6821 - DNA, 302 bp, Zea mays
  misc_feature: Incyte ID No: 700352455H1
  unsure 219, 228, 231-232, 239, 251-252, 258-259, 272, 275-276, 278, 291, 296-297,: a, t, c, g, or other
ccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctaaacctcngtttcgggnggnncccgggncaaggtatcacnncgcaannggggtttaaaacnttnngnccccctgaggggnggggnntttnt

SEQ ID NO: 6822 - DNA, 302 bp, Zea mays
  misc_feature: Incyte ID No: 700352456H1
  unsure 33, 64, 92, 110, 113, 119, 123, 132, 218, 243, 255, 260: a, t, c, g, or other
aattctctcccgctctcccctctgctgcaagtntgcaaccgcagcagcacgtccatttcacgtncccctttcctccctccctttcccctgcncccacgccacctccgttngcngccgcncgcngcgacggcnatggcgatgaccgaaggcttctgcctattacgcggacctacctcgcgcgctactacgacaagtacccgctgcccccgctgcccgangccactacggacctcgccgcccggntccgtgctctcnccgcngacctcgctgccgttgctcgatcgctccagatgaggagtttt

SEQ ID NO: 6823 - DNA, 301 bp, Zea mays
  misc_feature: Incyte ID No: 700352457H1
  unsure 110, 245, 258: a, t, c, g, or other
atcacccacctgctgctgccggtcctcttcccggccatcatcacgcaggtcgccttccccaactccgacttcacgcccgaccccaagtacaccctcaagggcgtcaactnacccgtccacgagatgtccatgtaccagaggcttaccaagcactccattgtgatcgatggatcccggatgtcaccattgggctggagtggactgtcgtgggcaatcggcatcctcatcgtggcgccgctcctcanccagaccgctcancatctcgaccgtggccagtaccagtcgctgatcctcattgccg

SEQ ID NO: 6824 - DNA, 292 bp, Zea mays
  misc_feature: Incyte ID No: 700352459H1
  unsure 2, 18, 234, 240-241, 248, 250, 257, 266, 273, 277: a, t, c, g, or other
gnagttgccatgattttnttttacttaccattctgcaatcatccttgcttccaaacacagcacgctaatacaggtgcgtacttgtgcaggactggtagagggaaggtttccttggcagccatcactctagatgattaccttccaatgcgaagactgaagtgaagaaccggtaacttgtttatttctaaaagaatgctgacaatactatttcatctgtattttggcagtattttngccttnngccctcnanaggtttnttttggggnaattgcntatncatccctcaaggggg

SEQ ID NO: 6825 - DNA, 304 bp, Zea mays
  misc_feature: Incyte ID No: 700352460H1
  unsure 109: a, t, c, g, or other
agcactgcttcttctcaacaacgagcagggacgagttgtttctaaaccttgtcatggaatttgtccccgagaccctgtaccgtgtcctgaagcactacagcaacgcganaccagaggatgcctcttatctacgttaagctctacatgtatcagcttttcagaggcctagcctatattcataatgtaccaggagtctgccatagggatgtaaagccacaaaacgttttggttgatcctctcacccaccaggtcaagctctgtgactttggtagcgcaaaagtcctggttcctggtgaaccgaaca

SEQ ID NO: 6826 - DNA, 293 bp, Zea mays
  misc_feature: Incyte ID No: 700352463H1
  unsure 157, 170, 181, 208-209, 224, 234-236, 243, 254-255, 266, 279, 282: a, t, c, g, or other
ctcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttggttaagttgtcgatgcgnacaaagtgtttcngttagtttggngctggagtctgaatattactttaaaannttaaaattgggccgngttgaacaannnttttttngttgggccccnngtttgggggcncggaaattggggnccnggggttaattt

SEQ ID NO: 6827 - DNA, 312 bp, Zea mays
  misc_feature: Incyte ID No: 700352464H1
  unsure 4, 44, 216-218, 232, 234, 237, 247-248, 252-253, 255, 266, 271-273,: a, t, c, g, or other
ctanacaaaagcaaattctcaaggttgttgtcacggaagttctnggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgttgacaactcctggaacagagctnnnattgttaatggccncngtncgttgaatcnncggnngnaaatttggaantttcnnnttggcnnggccccnccanggggngggtnnnnaaggtttt

SEQ ID NO: 6828 - DNA, 308 bp, Zea mays
  misc_feature: Incyte ID No: 700352465H1
  unsure 39, 205, 299: a, t, c, g, or other
atctccacctctcctccggctagggtgttcacgcctgcngcggcgaacttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacacngttatttctctcttcatttttctggtgtgcagccagctcccactctatggcattcattcaacgactggagtgatcctttctactggatgcgtgntatctcgca

SEQ ID NO: 6829 - DNA, 288 bp, Zea mays
  misc_feature: Incyte ID No: 700352469H1
  unsure 223-224, 236, 240, 245, 248-249, 258, 264, 270-271, 274, 280-283, 286: a, t, c, g, or other
cccgacctcctccgccacagacccgtttccccgctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggcttccaagcagctccaagacatccgccggggcctcagggggactcggtgggcttnngggaaaaaaccntttntgggngtnnaaaggtttncggggnaagggnnaantttttnnnnttntg

SEQ ID NO: 6830 - DNA, 289 bp, Zea mays
  misc_feature: Incyte ID No: 700352470H1
  unsure 102, 152-153, 155-156, 158, 160, 202, 212, 226, 231, 233-234, 236, 241-242,: a, t, c, g, or other
ctgaggaatcctacacacccgagctgctctattcctacttctatccattgcctctccactttgctaagagaaccatatgttaggacattatttgttcaagcngatggcatcaagctgctcattcccttaatttccccagcttccacacaacnntnnancnggctcctttatgaaacttgcctctgcatctggcttttatccnttatgatgcngcagttgattattngcccncnnangggtnnccaanntnnnnangggttnnaggggnncnaaaangggggggtnttnt

SEQ ID NO: 6831 - DNA, 296 bp, Zea mays
  misc_feature: Incyte ID No: 700352472H1
  unsure 9, 26, 86-106: a, t, c, g, or other
aagccagancctcgcaggagggagangggggagagcggaggagaaaccacctttctttccgttccagacaagctcccagcactgannnnnnnnnnnnnnnnnnnnntgtgtgtgtgctcccttagtagttagtccctgtcgcgtcccggatcggagctcccctccgtgcacgggacaccgccggtccgggcgtctccactcccccccggatcgatcagctccgcctccgcaagataggcaagcaatgaggtgcctgcctttcttgcatggagacaccaaagagaaggatccagtca

SEQ ID NO: 6832 - DNA, 287 bp, Zea mays
  misc_feature: Incyte ID No: 700352474H1
  unsure 205, 211, 232, 243, 245, 252, 259, 261, 263-265, 269, 271, 273-276, 280,: a, t, c, g, or other
atctcgtcttgtgttgttcggagcgggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttaagngccganttgacatgaagaattgttggnaaaacttttgnantttgggngaaattntncnnntttntntnnnncccnggggntt

SEQ ID NO: 6833 - DNA, 294 bp, Zea mays
  misc_feature: Incyte ID No: 700352475H1
  unsure 40, 68: a, t, c, g, or other
cctgctgcgcgctactcgcccgatctcgcggtgctggtancggtgaaaatatctgagatcgagcgaantaggcttttcatcgatatggcgcttgtactgcatgctggcagtagtaacaaaaatgcattcaaaacactaattgccgcggattacagcggcatcaaggttgagttggtaaaagactttcaaatgggggtttccaacaaaacaccagagttcctcaagatgaaccctattgggaaggttcctgtcctggagacacctgatggtcctgtctttgagagcaatgcaatt

SEQ ID NO: 6834 - DNA, 318 bp, Zea mays
  misc_feature: Incyte ID No: 700352476H1
  unsure 221, 307, 317: a, t, c, g, or other
gagcaaaaaaaattcgtgtgcacatccttaccgatgggcgtgacgttttggatggaagcagcgttggtttcgtggagaccctagagaatgatcttttggagcttcgaggcaagggtattgatgcacagattgcatctggtggtggaaggatgtatgttaccatggaccgttatgagaatgactggggatgtggttaaacgtgggctggggatgctccaggntgctcggagaaagcaccctaacaaatttcaaaaagtggcacttggagggctgtgaaaaaccagtgaagaagccacaagcccccaanggctaaatgnt

SEQ ID NO: 6835 - DNA, 298 bp, Zea mays
  misc_feature: Incyte ID No: 700352477H1
  unsure 35, 42, 45-46, 59, 61, 72-75, 80, 84, 135, 187, 215, 288, 291, 295: a, t, c, g, or other
gatgtttagtacatatagtataaaaggcaacatancacttangcnnacacacacacaancngagagtatttnnnnttgtnacanaaaccttgccttttatactatatgtactaaacatcaattatagctaataanaggcaaggtttttgttacaaagaaaatactctctgtttgtgtgtgtgtaacncttaagtgttatggattattcatttttngtaaatttagtgatatttttatttgacctgctgcacacctagctaatagttcatttctctgttggcatagcangangggnccc

SEQ ID NO: 6836 - DNA, 299 bp, Zea mays
  misc_feature: Incyte ID No: 700352482H1
  unsure 103, 168, 182, 239, 270: a, t, c, g, or other
accaaatttaagtcaaggagtgctacagtccatccctggatctagcggacggctgtgtttggcgctaaaactgtttcgcgtagagatgactttaacgtcagtngctgcaccttaagagctaccctatacgtgcactgtacaaggggagagggaggctcgccgcaagcnctgcggacagcctnccgctattcattgaatagatctctcctcatggattccctccattttcatatcatcanaccagccctaccagtccaaggtttttctaangaaatttttatttaagggtagtttggaac

SEQ ID NO: 6837 - DNA, 290 bp, Zea mays
  misc_feature: Incyte ID No: 700352485H1
  unsure 230, 249-250, 256-257, 276, 281, 284: a, t, c, g, or other
attcagggaactgaagttgccaaggagagttctgatattattatcttggatgacaatttcgcatcagtcgtgagggttgtcagatggggtcgttcggtgtatgcaaacatacagaagtttatacaattccaactaacggtcaacgtcgcagctctgataatcaatgtagttgctgccgtcagttctggaaatgtgccgttgaatgctgtccagttgctgtgggttaaccnaattatggatacttggggnnccctgnntggggaaagaaccccttanaaccnccngggggg

SEQ ID NO: 6838 - DNA, 286 bp, Zea mays
  misc_feature: Incyte ID No: 700352486H1
  unsure 137, 153, 168, 232, 239, 256, 262, 267-269, 271, 276: a, t, c, g, or other
ttcttgactcttctcttctccccatcagccagcagtctctctctctcacacacacacaagcagcgacttgctcacagtagtgctccccggacagaatgaccaaagacgaggagttcaagctggtcaagatccagaancatgcgctgaaggtgnacatacactgcgacnggtgcaagcacaaggtcaagaagcttcttcagaagatcgaaggcgtgtactcggtggccattgntgtgganaaccacaagtttcggtnaggggnttttnnntntgganccctttttat

SEQ ID NO: 6839 - DNA, 292 bp, Zea mays
  misc_feature: Incyte ID No: 700352487H1
  unsure 5, 13-14, 26-27, 36, 66, 113, 119-120, 164, 180, 210, 241-242, 247, 256,: a, t, c, g, or other
cttgnaccatttnngcaaccccgcannagcaaaagnaaggccgaaacgaggccaccagctcaccgncgagcggaagggtcgccgagcaaccaacccctctcctcgtccgccgncgtctnnccggaccatggccatggccgccgcctcctcccggctgctctggncgtcccgcgccgccgnctacctcaggatctccaccttccccagggncttctccaccgtgctgaaggatctgaagtannctganactcatgantgnttnaagggcagggtgnctcagnnancntgggtt

SEQ ID NO: 6840 - DNA, 286 bp, Zea mays
  misc_feature: Incyte ID No: 700352489H1
  unsure 101, 203, 281: a, t, c, g, or other
gacaaacttgttgacccattgtgtgcccaagaaaaatgtaacgacgaggatgatcaaggcatggccatggcttacaaatcagacctaacttgcaaaggagnatatgatgttaatgatcagtatgatgggggcattagtacaagaagcaaacaggagagcaatgaagatgacaaagatgccactgaagatgaaatctcatgcanaagttatgaacagaagagcaaggaagataactcatgcaccttgaagatagtagcaaaacatatgagcagattagtggngaagt

SEQ ID NO: 6841 - DNA, 290 bp, Zea mays
  misc_feature: Incyte ID No: 700352491H1
attttttcatctcattcggcgccgcggcaccccctgctcgtcactcgcgatggcccggatcaaggtgcacgagctgcgcggaaagagcaagacggatctgcaagcgcagttcaaggagcttaaatcggagctctccctcctacgcgtcgccaaggtcaccggcggggctcccaacaagctctccaaaatcaagattgtgcgcacctccatcgctcgcgtgctcaccgttatctcgcagaagcagaagtcggcgctgcgtgaggcgtacaagaagaagaagttctcccgtt

SEQ ID NO: 6842 - DNA, 76 bp, Zea mays
  misc_feature: Incyte ID No: 700352495H1
  unsure 63, 65, 67, 70-71, 74-75: a, t, c, g, or other
acagaatgaatgagtttgatcctatcaagcagcaccggacgttctgcccttggacttccccancnanggnnagnnc

SEQ ID NO: 6843 - DNA, 297 bp, Zea mays
  misc_feature: Incyte ID No: 700352501H1
  unsure 12, 16, 59, 88, 273: a, t, c, g, or other
agcgagccgcgnagtngaactgtggaagcgtcgagcttttttcttctttgtcttgctancgcaagaacgaagggaaacgagaggaggncggcgatggcgaagaggctgctcccgtcgctgaaccgggtgctggtggagaagctggtgcagcccaagaagaccgccggcggcatcctcctcccggaaacatccaagcagctgaatgctgtaaagtggtggctgttggccctggtgagcgcgacaaggcaggcaatctgatccagttgtctgaangaaggcgacactgttcttctgccg

SEQ ID NO: 6844 - DNA, 293 bp, Zea mays
  misc_feature: Incyte ID No: 700352502H1
  unsure 153, 185: a, t, c, g, or other
acaaaggaagcactgaccagcacgcttacattcagcagctgagagaaggtgtacacaacttctttgttacttttatcgaggtcttgcgtgacaggcctgctggtcatgattgggagcttgaacctggagtcacatgtggtgactatttgtttnggatgttgcagggaacacgttctgctctttangcaaatgaccgtgaatctatctctgttactgtgcaagaggtaactcctagagctgttggagcactggttgcactttatgaacgtgctgtggggctttatgcttctttg

SEQ ID NO: 6845 - DNA, 291 bp, Zea mays
  misc_feature: Incyte ID No: 700352503H1
  unsure 98-120, 192-216: a, t, c, g, or other
gcgaacgccaagatgggtaatggcgcccagaggaacgctggcgccatgggtggcattggcatgctgggcctaagccatggcctgggagcgggcggcgnnnnnnnnnnnnnnnnnnnnnnngcttccagcaaggctacgcaggcttcaaccacccgccctatgccgctgctgccggctatggaggaggtctannnnnnnnnnnnnnnnnnnnnnnnnagagtaacagcctcatggcgagcatgcaggggtaccatcatcaccaataccctgccgcgacggccgccgtggtga

SEQ ID NO: 6846 - DNA, 294 bp, Zea mays
  misc_feature: Incyte ID No: 700352505H1
  unsure 275-277: a, t, c, g, or other
gcacttggttgctagcgatgttgtgtctgggccactgatctccttttcaggcgtcgagagagtggggaatatcgttcaggcgttgaggatcacaggccacaacggatttccagtggtcgatgagccacctctatcagaggctccagaacttgttgggcttgtgctcagatcccatctgctggtcctgctgaaaggtaagggctttatgaaagagaagatgaaaaccagcggtagcttcgtgctggaaagatttggtgccttcgattttgccaagnnnggctcagggaaaggcct

SEQ ID NO: 6847 - DNA, 295 bp, Zea mays
  misc_feature: Incyte ID No: 700352506H1
  unsure 38, 94, 108, 221, 246, 269, 286, 294: a, t, c, g, or other
gcgctgatcgaccacgtcgcgcgcgtcgactggtcccncctcgaccgcgtccctggcgaccgcggcggctcgcagcaggtgtccattgtggagntgaatcatattctnaatgaagtgaatacccacatccttccttcccacaatgatctcaccccaataactacaatagccggtggaagtgttgccaacacaatccgtgggctctcagctggttttggaanatcaactggaataattggagcttgnggggatgacaaccagggactttngtttgtcaacaatatgngctttagng

SEQ ID NO: 6848 - DNA, 297 bp, Zea mays
  misc_feature: Incyte ID No: 700352507H1
  unsure 63, 212: a, t, c, g, or other
atctccaccagccggtcggacttcttgcgctccaagaactcggcgaggatggaaatgtttttnggcagctttctcagtgaatcagtatcaccgcagaaccttttcggacaaccggatgttgagagatgcccattcctgaggaatatcaatggagctacaaccttttccctcgcttctgctttgccagtagctgctcaaggaggcaagggtcnaatttttgaggaagggtcaggctttgagtcagcattcaagcttttccatggccgagatggaatagttcccctttcagaaagatca

SEQ ID NO: 6849 - DNA, 103 bp, Zea mays
  misc_feature: Incyte ID No: 700352510H1
  unsure 51-52: a, t, c, g, or other
gtgttgaagaagcatgttgcagaagatgcagaatacaaagttatagtattnntgtactactgcaatggttacaagacttgttgctgaggtactctcccagcta

SEQ ID NO: 6850 - DNA, 298 bp, Zea mays
  misc_feature: Incyte ID No: 700352516H1
  unsure 192, 195: a, t, c, g, or other
tcaccgcctacgtagaacccctccgctccttccagctcgctctctacctgcaccagcctcgcccgcccttcgctcgccgccgccatggggaggggaaagttcaagggaaagcccaccggccgccgcaacttctccacaccggaggagatcgctgctggtacttcaggtcgccctcgcacctttaagaagaangangaagaggaagaggaggaagaagaaagagaagatcagaggaggaagatctgaagacgagtctgatgacaaacctaaacataaagtactgagggtattattcaga

SEQ ID NO: 6851 - DNA, 289 bp, Zea mays
  misc_feature: Incyte ID No: 700352519H1
  unsure 166: a, t, c, g, or other
aaatgctggtttggacagcgctgagttgatctctcagctccgagctgagcaccacaaagagaactgcactgctggaatcgatgtcatcactggcaccgttggggacatgcaaaggctggggattcaagagtcgttcaaggtgaagcaggccatactcctgtctgcnacggaggccgcggagatgatcctcagggtcgatgagatcataagctgtgccccacgcagaagagaggataggatgtgattagacacgctgtttctcggtgtagtggggatgcttgttacccta

SEQ ID NO: 6852 - DNA, 75 bp, Zea mays
  misc_feature: Incyte ID No: 700352521H1
  unsure 33: a, t, c, g, or other
gcgaagttgtatgaaaatcacttaatgtatgancgctaatgtgacaattaattttgcaaaggtgagatatttacc

SEQ ID NO: 6853 - DNA, 289 bp, Zea mays
  misc_feature: Incyte ID No: 700352522H1
  unsure 108: a, t, c, g, or other
gcgtcagagcccgatcccgatccagcgaggcggcgaccctccctcctccccttgcttcgctcgtccagccctgaccacccgcatccccgtcagtcatggcagcggcanaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggatctacatcatcaaccttggcaagacatgggagaaattgcagttga

SEQ ID NO: 6854 - DNA, 291 bp, Zea mays
  misc_feature: Incyte ID No: 700352523H1
attcaagcatatgcatatacaccaaaagtcatgattgagcaatgctgtggtgcttcagtgtgtcttcccagtttcattcggtgagtggtggatgaaggcttcagtttttattagcaccgattactgtatgttgtataacttcagtaacatttctggtagaaactatgtgggtagctgatgtcaaagtagtaggatacatgcttctattccgaaagctacctctgtgggctgtggccaaaatagactcttatgagcacacatggttttgtaagctgtaacaaggataacttc

SEQ ID NO: 6855 - DNA, 136 bp, Zea mays
  misc_feature: Incyte ID No: 700352524H1
  unsure 57, 80: a, t, c, g, or other
gatgcatcatattggactctatatggccaaaggaaggggtgcaaagatagttgacanggtggttattgaaccacgaatanaaaaactttccctcgtcatagtgatgttgctagggtttccttccattgtaacaacc

SEQ ID NO: 6856 - DNA, 293 bp, Zea mays
  misc_feature: Incyte ID No: 700352525H1
aagagacttattctggaatctttaaaagcatcaacgtcggtattcaagaactcaaagagcaactgaagatgctgaagatggaagaccaaaatgacatttgtggagactattctgatacattgtcaagcgacgagttcgataatatgaacatctcaatatatcgaaccatggaagagcagttgtctatgtttaaggatggggaggacagagatttctcttatgtacaggacatgcttgctagcgcgtgcgacttgccagagcacctagaagattggcaagtgagctcagatgtg

SEQ ID NO: 6857 - DNA, 292 bp, Zea mays
  misc_feature: Incyte ID No: 700352527H1
  unsure 23, 262: a, t, c, g, or other
agccaagcattctcacgttttcntcgtccggccggccggcgagcattttgcttctgcgatcgatcggcgcgacgtgcacggccatggagatgatcgacgcagagctgcgtctgggtccgcccggcagcaacaacagagacgtcatcaacgtcgtgcagccggcgttggcggcggcgaaacggccgtcgtcgtcggtgctggagagcgaggcgtccgggacggagaccatgaccatgacgacgccgcaccgacctccaaggtncaggtggtggggtggccgccggtgagagtt

SEQ ID NO: 6858 - DNA, 278 bp, Zea mays
  misc_feature: Incyte ID No: 700352534H1
  unsure 33, 38, 42, 61, 82-111, 153, 173, 183, 253, 269, 271: a, t, c, g, or other
ccagcgcccctcactgcgcatccgcatcactgngtgtnctcntcctctccccctcactgcngcgaatccacatccgccaatnnnnnnnnnnnnnnnnnnnnnnnnnnnnnnctgtgcctcgacatctcgcatccgctccatctatggaaggcnaccacgcgccatggatcgcngctctctacngccacctcaattgaaggttcaccgctctctacgtggatccgccactctcctcggccgccgtcaatggaangtccagatctctctcncnattattt

SEQ ID NO: 6859 - DNA, 277 bp, Zea mays
  misc_feature: Incyte ID No: 700352535H1
  unsure 72, 137, 149, 248: a, t, c, g, or other
agtcgtggacgccatgggccgaggccgcaaccgcaagccccgcaacttcgccacgttccgcctctgcccgcnccccggggctgccgatgcctccgaacgcgtcttcgtacgcgtcgacgacaacccctactccgtcnccgggttcgcanacgatgatggtctctcgtcctccaccgccgtcaggggagacggcggcgagcccgacccgtcctcctccactcgaccgacgagggcgggtcccccctgcncgagacgtccgcgagagatatggagtcgg

SEQ ID NO: 6860 - DNA, 282 bp, Zea mays
  misc_feature: Incyte ID No: 700352536H1
  unsure 6, 37, 121, 164, 167, 183, 194, 213, 230, 244-245, 270, 272, 276: a, t, c, g, or other
attgcnccttcttctacaaataccccggccggccgcngcgtttcccgaatcgagcggtgactggcgaggcaaaagcgcaaacgcgaccacagacagagcgcgcttcaaggccttttttttntttgagataacaaggaggagaggaggagatggcggtcacgatnatntgggtgaaggcgaggnagatcttcganagccgcggcaaccccaccntcaaggtgaattgggcntaagcgacggaagnnacgcaaggggggccgtaccaggggngnatcnattgga

SEQ ID NO: 6861 - DNA, 289 bp, Zea mays
  misc_feature: Incyte ID No: 700352544H1
  unsure 43, 126: a, t, c, g, or other
tccaaacaagggttgaccggcgcgcaaagcaaatccattcgcncccccgcagcgttggaacgccaagattgaatagatggtggtggtggacaaagaaagcttagtgcctggtggcggcggcatctnattctgatttctggagactccctcctttttttttagcagtattcaaggaggaggggtggctagatctgctgtagcggatgccaacagaaatggacaaggaaagaggtgccaagcgcataaggagaaaggggcagatgcgtctggtggcctagagtggaataaa

SEQ ID NO: 6862 - DNA, 289 bp, Zea mays
  misc_feature: Incyte ID No: 700352545H1
ggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagtg

SEQ ID NO: 6863 - DNA, 288 bp, Zea mays
  misc_feature: Incyte ID No: 700352546H1
aggccaaggaggcggcggttctggccgccgagctagtgcagctcagggcgaagatctccgcgttagagtctcgcattgcagagcagaacctggagttcaagaccaagaatgatgcaatcgaaacactgaatatgattgtcaaggaaaagtcacagaagattgctactatgcagaatgaagtaacttccctcgaggccaaagggtctttagctgcagaggagcaggcaagcaaggccaatgcactggctattgagctcaagaagcagaccgagaactcagaaggatatt

SEQ ID NO: 6864 - DNA, 270 bp, Zea mays
  misc_feature: Incyte ID No: 700352547H1
  unsure 4, 130, 174: a, t, c, g, or other
aggnagtgaagtatctactgaggagatgctagagcttgaaagtaatgccactaaattaaacaaggatcaatcagaacttgaagggctttcatctggtaggaatcctccaaacttccaaagcaatccaaangctgggcagcgatcagagtccaaaggcattgtggccgagaaggnagctgaccatataatggaagctgaagatgatgtggatgctgagcactcatcagaatctcaaagcgttgcacctgctgaggttcgaaaggagcaacc

SEQ ID NO: 6865 - DNA, 307 bp, Zea mays
  misc_feature: Incyte ID No: 700352551H1
tcctctggcggtaagccatgggagatgcagcagtattcgcagcagaggcctggttatggatccaactcccagttgaatgatgatggatcatactctgatgcccaggacagctatgctccttcctattaccagaatggaaaggcccctgattttcaatcagatgaacctaggtctttgacctacaacactgggattgaggagagaccgccgccgcctcagcgccgctgggtgccccctcagcctccaggtgttgcgatgccagaagcagctgctgctatacgtcaaccaaaggtccctccaaagcagc

SEQ ID NO: 6866 - DNA, 306 bp, Zea mays
  misc_feature: Incyte ID No: 700352553H1
tgtcagtgtgtcagatgtgccgtaacagatgactccaaaatggattgcatgctcttcaaatagctacagataactatcttcacataaaatggagagtacaatgtttataaaagaaggaatatggataaggatccagattctcctatagcatatgaagaggcaaaggaaatggcaagccaaagctgcacaatttctgatgatcactcgttgttactgttatccattatctcctcagaggcattgcttttaaattcaacagcagacatggcaggtgcaggtcctatcctatccattatctacccctgc

SEQ ID NO: 6867 - DNA, 296 bp, Zea mays
  misc_feature: Incyte ID No: 700352555H1
  unsure 137: a, t, c, g, or other
ctctctgatttttggcgagcagaacatacctgagacgacaggtagaagacgactgactgcctcgagcagcagagatcagggaggccgagggcgggatgacgatccggttcgtgctgttcgtcaacaagcagggccanacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttt

SEQ ID NO: 6868 - DNA, 304 bp, Zea mays
  misc_feature: Incyte ID No: 700352556H1
  unsure 2, 4, 156, 203, 207: a, t, c, g, or other
angnctacaaaatgatccatgggcaaacaagattggttctaatgaaggtaaagaacaagaaactgatccttgggccagcaagatgtcttctactgtgtgtgctgatgacaagaaaggtagctggaacactacagcaaagggcattccatctaaggnaaaggctgatgatccatggaatagtaaggggggtaatgatgacagcnaganaactgacacctggggtgctggctcgtcaggtggggatcaggaactttcttggagcaaacctaatttctctttgggggaccaggaatctacttggaac

SEQ ID NO: 6869 - DNA, 302 bp, Zea mays
  misc_feature: Incyte ID No: 700352557H1
cgcaaaggaccatataccaatcatcgcatctgtttctgagcatcagccaacagcatggtcctctttcatgtttgacttccacatcctacttttcttgttcccagctggcctttatttctgtttcaagcgcctgtcagatgccacgatatttattgttatgtatggcctcacaagtatgtactttgctggtgtgatggtccggttaattcttgtggcagcaccagctgtttgccttattagtgcgattgctgcatctgctacaataaaaaatctaaccactttgatccggacaaagagcaaaa

SEQ ID NO: 6870 - DNA, 319 bp, Zea mays
  misc_feature: Incyte ID No: 700352560H1
  unsure 23, 29, 234, 316: a, t, c, g, or other
ccaccctcgtctccgcgcccgcncccgcncccgcgccactcacatcgtgatcgagacgacccgcgtcctccgcggtcccgcgcccgtggcaccatctcgcctcgcattcccgaaagtatctgtattccttgatcaacatgtcgcgggaggagaatgtttatatggccaagctggctgagcaagcagaacggtacgagggaaatggttgaatacatgggagaaggtgggctaagnaccacagatgtggcaagagccttcactgttgagggagcgtaaaccttctatctgtttgcctttcaagaaatgtgatttgcgngcc

SEQ ID NO: 6871 - DNA, 194 bp, Zea mays
  misc_feature: Incyte ID No: 700352561H1
  unsure 86: a, t, c, g, or other
agtgatttcaaccagagtctcgggcggcaatctgtgcgttgttgctttggccatggtgctgctactgtaatccgtcggtgccagcnaaacgcggaactagatggctagttcacagcatgttgccatggttgtttggcatggctggcccggcaacctattttgtactagaggtgctgcatccttgtgttcctgtg

SEQ ID NO: 6872 - DNA, 298 bp, Zea mays
  misc_feature: Incyte ID No: 700352562H1
  unsure 291: a, t, c, g, or other
acgatagcaagcctagagacagagctctcagctgcaagatcgctgcaagaatccctgctgaacggctcccctgtcgcggaagagtataaagtttctgaatcaatcgggaggcgaaagtaccttatggtgatagggatcaacaccgcattcagcagccgcaagaggagagactccatacgttacacctggatgccccaaggtgaaaagaggaaaaagcttgaagaagagaaggggatcattattcggttcgtcattggccacagtgctatatcaggtggattgttgataganccatcga

SEQ ID NO: 6873 - DNA, 305 bp, Zea mays
  misc_feature: Incyte ID No: 700352565H1
  unsure 44, 108, 140, 192, 207: a, t, c, g, or other
gcgcggtgaaggaggatgaggttaagatttctgtcccccccgcnccggtcatggggttaccgggcggagcggagggcgtgagtgtgcctggcggcggaggcgggaggnaacggaagcggcacttgtgagtacagtggatngcgctcgtcctgctatccagcgagagaaacgaatgataaaaaaccgcgagtntgctgccaggtcacnggagaggaagcaggcctatatcgccgagctagaatacatggtaacgcggctcgcggaggagaaagctgagttgctgagacaacaggaagagcagttcc

SEQ ID NO: 6874 - DNA, 303 bp, Zea mays
  misc_feature: Incyte ID No: 700352566H1
gatgacatgaccaaagagaaagatctaaacattggggaagctacataatctgagaagtgtattggtgatgtccccatagaatgtgataaacatggtgatagtgaaccattgagcatggaaggcaaaatcatttctggcaatgtgaatgtgaagaaccaaatatcgagggaggatctaaaagaagcattcaaaaattttggaactgtccggatgcgccaacagagtgaaaccctaggaaaacatgccatgcactttcttgctggttatatttccatgttttctacacagggtccttttcagaca

SEQ ID NO: 6875 - DNA, 300 bp, Zea mays
  misc_feature: Incyte ID No: 700352569H1
  unsure 82, 212: a, t, c, g, or other
acgcggcaaggtgagagggcgagttagaggctggcagttaccgtgcaaaggccaaggccaaatggcgcagagtccgcttgcncggagctcgcagaacaagcacctgggatgtgattccaacgggcaatcctgggaggatgtgtataagcataagttggagcagaagtatcttggtcaaggagaggatgataggaggagcaagctgacaaganataaggatgataaagcaagtaggagcaatggttctggttcgtttgggaaagaccatgatcgaacctcgttggttggatcagatgatag

SEQ ID NO: 6876 - DNA, 300 bp, Zea mays
  misc_feature: Incyte ID No: 700352570H1
  unsure 57, 157, 159, 168, 179: a, t, c, g, or other
caataaggtaaggggtgacgaaaatggctccaacgaccgccaccaaggacgacagtngctacggcgacgagcgccggcgcgagctgcaggcgttcgacgacacgaagctgggggtgaaaggtctggtggactccggcgtcaagtccatcccgtccancntaccaccanccgccggaagncctgagcgacataatttctccggcgcctctgccgtcgtcgccaccctccggcgccgccatcccggtggtggacctctcggtgacgcggcgcgaggacctagtcgagcaggtgaggcacgcg

SEQ ID NO: 6877 - DNA, 296 bp, Zea mays
  misc_feature: Incyte ID No: 700352572H1
tgggtgaacaggtgacaacaccccaagtcaatgaggatgatttgacacttgagaggcttgaagattttcggtctcaactccaggagcttgagaaagagaagagtaataggctggagaaggttcttgagtatgtaattatggtacatgatctttgtactgtcttggggatggattttctcagcacagtgactggagttcaccccactttagatgactctgttggcgacaactgtaagagcattagtgatgatacattatcaaaacttgacaagacggtagctacacttaatgaagat

SEQ ID NO: 6878 - DNA, 297 bp, Zea mays
  misc_feature: Incyte ID No: 700352573H1
tgggagcggttgttgcacagaaaagaagagtggtgtgaagagatatgcagcagtaataaaaaagacaattcattacggaggactcggttgaataactctgatgccgtatatgttcaggatttagtgacggaggtgcagagggcactatgccgtacgttcctgaacttcactggcaacatcgaggaagaaagtgagctggaaaccctcatagacatgcagcttgtggagctccgcaaggtgttcaggataccccataagcctttcgatgaaacgcagggccctacctccaagaagctc

SEQ ID NO: 6879 - DNA, 296 bp, Zea mays
  misc_feature: Incyte ID No: 700352574H1
  unsure 164, 201: a, t, c, g, or other
ccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggngccgccgccgccctcgtcttctcatgcatgggcgcangtaacgggaccgcgaagagcggacgtcggcgtggcgtcgatgggtgtgatgcggccggagctcgtcatgaagtccatcgtgcccgtggtcatggc

SEQ ID NO: 6880 - DNA, 295 bp, Zea mays
  misc_feature: Incyte ID No: 700352576H1
  unsure 2, 85: a, t, c, g, or other
gnactgtgtgggctacctctagctgaatgctcacatccttcactagcacgctcacctgaatcatctccatcgcctcaatctccanctttgacacatcatgataagaaactaggcacgggtttcatagttgcagttgctgttggtgggtttgcattgctgatgctagtcgtggttgtgtgcttttcaaagaggaaaggcaaggacgagattgatgtggaatccaaaggtaagggtactgccaccaggagcgagaagccgaagcaagaattcagtagcggcggccaaattgctgaga

SEQ ID NO: 6881 - DNA, 293 bp, Zea mays
  misc_feature: Incyte ID No: 700352577H1
cttcaacgcatctcaggatcttgcttcaccatctgatagtgatggccatgggacgcatacagcatccattgctgctggcaatcatggaattcctgttgttgtggctggacatcaatttggaaatgcaagcggcatggctcctcgtgcacacattgctgtctataaagctctttacaaaagctttggtggttttgctgctgatgttgtggctgcaatagatcaggcagctgaagataatgttgacattatcagcttgtccattactcctaatcggaggcctcctggactcgcaa

SEQ ID NO: 6882 - DNA, 291 bp, Zea mays
  misc_feature: Incyte ID No: 700352579H1
  unsure 50, 230, 235, 252, 255, 259, 266, 269, 272, 277, 283, 285, 287, 289: a, t, c, g, or other
caccagtccaccgccaccccatccaatcccatccccacaaccgggtgccnccgccttctatggcggacttcggcgacgagctctttctcgacgtcggggacgatggtttcggagacctctcctacgtctccttctccgagtccatcgagttggatctcgcctgcccacgcgacgtcttttccgcggggtttgatcccgaaaccctaacccacatcccggggtccccaatntcctncgattcgaacccggatntgngacnctttctncgngangagtnctcccngntngngg

SEQ ID NO: 6883 - DNA, 293 bp, Zea mays
  misc_feature: Incyte ID No: 700352581H1
gccaaataggttctaacaagtatgctgtcttcattatcttctcaaccatggtgtcagtactgcttcagatcctttctttaggttacatgaaagatccttctctaaatccttgacatcaggaccatatggcctcatcttgcatctatgtgccattcttctttgacattccaatctcaatgaagtttcgcatatttggactgagcttcagtgataagtcattcgtatatttggcaggactccagcttcttttctcatctggaagacgttccattgtgcctggactttctggcata

SEQ ID NO: 6884 - DNA, 295 bp, Zea mays
  misc_feature: Incyte ID No: 700352582H1
agctgataaaccacggtgttccggacgatgtgatggaggcgatgaaggccagcacccagtcattcttcgcgcttcctgcggaggccaagcagcagtaccgtcagcaggcaggacagctggaggggtacggccagctgttcgtcgtctccgaggaccagaagctggactgggccgacgtcctctacctcaacacgcagccgcccgagcaccggaacctcagcttctggcctgctggtgagagcttcaggcagacgctggacacctactccgccgccgtcaagcacgtcgccgaccg

SEQ ID NO: 6885 - DNA, 294 bp, Zea mays
  misc_feature: Incyte ID No: 700352584H1
  unsure 2, 91, 104, 111, 272, 286: a, t, c, g, or other
anaacacagctccaggccaaaacctcgccgcctcgccggcctccgcctcaattccatgcctcgccaatcagatccacgctcctcgccctcnactatggactccngcggggngtcctcagcggacatggagctggcctggcaccttctcaccgtgctcatccgcctcggccgtcccgccgccgcctcggaactcaccgccgccgctaccgtcgcagcgccctccatctcgacgcgcgtcgtcaagcagatgtgttgcttacctaggtcaccantatggatctctgangacggcgt

SEQ ID NO: 6886 - DNA, 290 bp, Zea mays
  misc_feature: Incyte ID No: 700352586H1
tattctgcaactttcaaactttaaggatgactcaagtccaattgcttgggattgttctgcctgggtgcgcacatatggtttgtttttggaagaaaggttggagtgcttcagagttctgaagtatgatgttgaagctgagcgtttgtccaaacaaggtcaaggtcctgaaaagggtcacagtagaaccagagagttggattcacaggatctgttagagcagctgccagcattgcagcagttactataccgactcgttggatgtcggcctgaaggagctgcaaataataact

SEQ ID NO: 6887 - DNA, 125 bp, Zea mays
  misc_feature: Incyte ID No: 700352589H1
  unsure 2, 6, 9, 17, 24, 28, 31, 48, 68, 74-75, 99, 103, 121: a, t, c, g, or other
anggcncgnacgtcatngaaagcntgangangtgatctgctgctgctngattgtggatgctacgttgntttcanncaacagctcatcgagagtacccgnagtncgtagtacggcaaatgtnaaca

SEQ ID NO: 6888 - DNA, 288 bp, Zea mays
  misc_feature: Incyte ID No: 700352591H1
tgctgacaagaggaaggagttctacacaaaattagaggagaaacataaagctttggaagcagagaaggacgaggctgaggccaggaaaaaggaagagcaagacgttgctataaagcaactaaggaagtcattggtgattagagcgaaacccatgccaagcttctatcaagaaggccccccaccaaaggctgaacttaagaaggtgcctcctactcgtgccaaatcaccaaagtttacaagctcaaggagaaagagctgcaatgacacaccacagacacccgagggaaa

SEQ ID NO: 6889 - DNA, 289 bp, Zea mays
  misc_feature: Incyte ID No: 700352592H1
  unsure 66, 185, 193, 203, 213-214: a, t, c, g, or other
cacccccacagcaactcccacctcatggagaaagctgcgcacgttgccgccggcgcgacgcaagancaggaatcgtctccgaacaggcttgacgacgcagcgaggcatcatggctctgctgaagcgattcctgaaagacttgcggtggtcacaggaggaaacaaaggagttggcctagaagtatnccgccatnttgctctcanggtgtgacannttatccttacagcaagggatgagaaacgaggaaaagatgctgccgagacccttcgccgtgaatgccaactcccaa

SEQ ID NO: 6890 - DNA, 286 bp, Zea mays
  misc_feature: Incyte ID No: 700352593H1
  unsure 283: a, t, c, g, or other
caccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaanggc

SEQ ID NO: 6891 - DNA, 303 bp, Zea mays
  misc_feature: Incyte ID No: 700380801H1
gttttttgattttagccgccgccgctgctcatctcacatccctcgagaagacgcctgctcctcgccgatcgatacgatgggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaa

SEQ ID NO: 6892 - DNA, 298 bp, Zea mays
  misc_feature: Incyte ID No: 700380802H1
  unsure 91: a, t, c, g, or other
attgttggacgcgttcccctcctgcacgcaacctcatctcgtcctccagatcctggatggccgtcctccttgatacttggcctcgcgagtnctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaagttcatgttgttttgttttggtggtcgagcatcgatg

SEQ ID NO: 6893 - DNA, 296 bp, Zea mays
  misc_feature: Incyte ID No: 700380804H1
  unsure 5, 8-10, 33, 56, 77-79, 95, 101, 104, 119, 148, 154, 160, 165, 169, 235,: a, t, c, g, or other
ttaanggnnnaaatataggtattgtgaaatatnttgctaatcttatagaacagganaaaatcccgttatttaaaggnnngagtatatttaacagntgcctnttntcttaatgtcagggnagatcttattttacagtacagtggggganataganacatgngaaangcanaaggcaggctcctaaattaatgtcagtgaagttcagggtgggcaaatgagtgtgtatgaggtatangcaatgctgatgacttctntaatgcttgaagtccgttcacaggtatctagccctagaatgc

SEQ ID NO: 6894 - DNA, 295 bp, Zea mays
  misc_feature: Incyte ID No: 700380805H1
  unsure 122: a, t, c, g, or other
gacagatacagatcgcgcgctgagatgtcgtcggactcctcgtcgtgggcgcgcgccctggtgcagatctcgccctacacttctccgccatcggcatcgctgtctccatcggcgtctcggtnctcggcgcggcatggggtatcttcatcacggggagcagcctcatcggggctgccatcaaggcgcccaggatcacatctaagaacctcatcagtgtcatcttctgtgaggctgttgcaatttatggtgtaattgtggcaatcatcctccagacaaagcttgaaagtgtgccaac

SEQ ID NO: 6895 - DNA, 294 bp, Zea mays
  misc_feature: Incyte ID No: 700380806H1
  unsure 15: a, t, c, g, or other
gcggcagcgcaaggngtcttcctctccgacgccggcaacgtcgacaccgctggcaaacttctctccgattgtccctgctccagtaagagtaggcgaggacgagcctcccccatcttgggtgttggtgcctgacccattttctcaagatatgatgttcacaagaggttctcccaaaattttgatgttatctaaagctgctcaaaagaaggtttctcctaaagcttctacatcaaagaagtgtggaggtggtgttcagagagcagcatggaattctgaattggagaagagcctcgt

SEQ ID NO: 6896 - DNA, 295 bp, Zea mays
  misc_feature: Incyte ID No: 700380807H1
  unsure 3, 5, 18, 70, 74, 80, 102, 104-105, 109, 183: a, t, c, g, or other
cgnantcgtgcgcctcgnttcgcttttcctccgcaaccatgtctgacaaacccgatatggctgagatcgngaanttcganaagtcgtaactgaagaagacananncgcnagagaaaaatccactgccttccaaagaaacgattgaacaggagaagcaagcaggcgaatcgtaatgaggcgtgngccgccaatatgcactgtacattccacaagcattgccttcttattttacttcttttagctgtttaactttgtaagatgcaaagaggttggatcaagtttaaatgactgtgct

SEQ ID NO: 6897 - DNA, 292 bp, Zea mays
  misc_feature: Incyte ID No: 700380808H1
ccacacccttcaatccgggaaaaaaaagcaacagctcgattgcccgggtcctccaaaaccctcgagatctcggttggtggtgtggtggggtgctcttccctctcgcctccgctccgaagcatcgatccgaactcctcggttactcgcggcagggcgtgtcgagatgcgccccaacattatcacagaggctgggattccaactaggttgaatcagtggtggagcagcattccgttcgttacttctggtgttatcttgatatgtggagtaatttatctgctctgcttgttgatt

SEQ ID NO: 6898 - DNA, 292 bp, Zea mays
  misc_feature: Incyte ID No: 700380809H1
  unsure 2, 17, 22, 24, 27, 31, 47, 55, 67, 71, 77, 99, 117, 135, 143, 165, 173,: a, t, c, g, or other
antctgctgccacaaanactgnanagngctnactgtcaacagctgangcaagccnagtgatcattantagngctttncttggatcccttcagtggtgtnggtagtaaaatggaaggngtctgctgcaggtaactnatgaagangtggtcaaccacagagtcttcnagaaatangaaattctgtaccanctgnaagnagttcttgttggtgcctncatttaaaaagcactccttnanataanagggcaatgntttctgataaaacaaacatttagttgaggntcttgatataa

SEQ ID NO: 6899 - DNA, 296 bp, Zea mays
  misc_feature: Incyte ID No: 700380810H1
cgattacttctattcatctgtccttgccctcctgatctatgttccaggaagcccacacatgtaccgttacatgctctccccagaggaagaaggcgctatcaaaggccaaagcggcgtgatgatgccgcgcaagcaagggaatcggtggactggtttgcgtgatggatgtcggaacgtgttcaagttttcgacatccccagtagaatctagtggtcgggggatatatattactagaatggggctcttcatatgaactgccccgtatgcgtaatgtgttgtaccggagtcatcatttc

SEQ ID NO: 6900 - DNA, 296 bp, Zea mays
  misc_feature: Incyte ID No: 700380811H1
aaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagt

SEQ ID NO: 6901 - DNA, 298 bp, Zea mays
  misc_feature: Incyte ID No: 700380812H1
  unsure 23, 30, 89, 159: a, t, c, g, or other
aagcctataggcacatgaaattngaaggangtgttcacagagtacaaagagtgccaaagacagaaaagcaaggccggcgtccatactancaccatgactgtagcaatattaccccagcctactgagattaatctggtgattaatccgaaagatttgagncattgacactaagcgagccagtggagctggggggcagcatgtaaataccacggacagtgctgtccggatagttcatcttccaacaggtgttgtttctgaatgtcaacaagagagatctcagctgaaaaataaagagctg

SEQ ID NO: 6902 - DNA, 299 bp, Zea mays
  misc_feature: Incyte ID No: 700380813H1
  unsure 84, 90: a, t, c, g, or other
cggcagtcctgtccagtggtgcagctgcctgccttcagccttccctctctttcgcgacccccccggagccggagcagagatcgncagctnctaccggcgcggaggcatggcgggggccggagacaaggtggactacgtcttcaaggtggtgctgatcggagactcggcggtgggcaagtcgcagatcctcgcccgcttcgcccgcaacgagttcagcctcgactccaaggccaccatcggcgtcgagttccagacccgcaccctcgtcatcgaccacaggagcgtcaaggcccagatct

SEQ ID NO: 6903 - DNA, 295 bp, Zea mays
  misc_feature: Incyte ID No: 700380814H1
  unsure 5, 13, 15, 20-22, 35, 39, 60, 67, 71, 99, 104, 112, 222, 259-264: a, t, c, g, or other
cacancaccatgngnccagnnncatggccacaagngagnagacccgagtaggcccgcggngaaaganagangctgtgtgtggctgtagtggagagatgnggagngactccgntccagtgtcaggggaagctgatggagaatcgagctctggatccagggactcgggactcctatggtgccaccagccacctccccaacaagggggccctggcgaaggtcaanaacaacttcaaagacttgatgtccaaactgacggagnnnnnntatgtctgtgccggtggacagatggcctgta

SEQ ID NO: 6904 - DNA, 112 bp, Zea mays
  misc_feature: Incyte ID No: 700380815H1
  unsure 44, 71, 96, 101, 108, 110: a, t, c, g, or other
taaaataatcttactgtaacaattcttagttttactaaatatcnttaatatgtttgtgaacatggttgatncttataccctttccaatagcttccnttccncacaacngnag

SEQ ID NO: 6905 - DNA, 303 bp, Zea mays
  misc_feature: Incyte ID No: 700380816H1
  unsure 4, 33, 49, 53, 63, 192: a, t, c, g, or other
ccanaaaggccttcgatacgggataatcctatntattacctcagaagtntttntcttcgcagngtttttctgagcctttaccactcccagccctagcccctaccccccaattaggagggcactggcccccaacaggcatcaccccgctaaatcccctagaagtcccactcctaaacacatccgtattactcncatcaggagtatcaatcacctgagctcaccatagtctaatagaaaacaaccgaaaccaaataattcaagcactgcttattacaattttactgggtctctattttaccctcc

SEQ ID NO: 6906 - DNA, 297 bp, Zea mays
  misc_feature: Incyte ID No: 700380817H1
tcaatcgcgaatattttgcagaagagcatgataggagggccagagctggcatagactatgattcatcctatgggaaggctcgtcccaaatgatacaattctgaagctacagaggacagcaccatattacaagaggaacagagctcatgtttgcagtttctttgtgcgaggtgaatgtacaagaggagctgagtgcccttatcgtcatgagatgcctgaaactggggagttatctcagcagaacattaaagatcgctactatggagttaatgatccagttgcactgaaacttttgagc

SEQ ID NO: 6907 - DNA, 291 bp, Zea mays
  misc_feature: Incyte ID No: 700380820H1
atgaagtccactatcctagggaaatatcactacatactttacattattgtcctggcaatgcagcccaggatgcttttaactgtcgatgaggatctgaagcccctctcagtacctgtccgcgttgggcaagctgtggacgtggttggtcaggcaggaaggcctaagacaattaccggctttcagacacactccacaccagtcttgcttgcagcaggggagagagctgaactagcaactgaaaaatacatcccactgactccggtattagagggctttgtgattttgaagaag

SEQ ID NO: 6908 - DNA, 287 bp, Zea mays
  misc_feature: Incyte ID No: 700380822H1
gtaagtccaagaagggtcagtatgaagggccagatatggacttagctgcaatgcttgaaagggatgttctggattctactccaggagtaagatgggatgatgttgccggacttagtgaggccaaacgactcctcgaggaagcagttgtgcttcctctctggatgcctgaatattttcagggtattcgtcgaccttggaaaggagttcttatgtttggtccaccaggcacgggaaagactcttttggcaaaggcagtggccaccgaatgtggaacaacattctttaat

SEQ ID NO: 6909 - DNA, 289 bp, Zea mays
  misc_feature: Incyte ID No: 700380825H1
gcagtctcgtcccacgcttggttttgatttgaatgttgccgatgatcaagctcttgaggaagatatcccacagagttctgcacaaactacctgttctgaatctggaaatacgagaagtcgagatggctcttcacgaagcgctggtattgaatttgatctgaacagagctgatgaagttgcagataatggccaatttgtgccaagtgcttcgcacagagttgaagtgccattgttgtcaacaagatcgttacatggagttttctctaatgctggcctgaatagctcgagg

SEQ ID NO: 6910 - DNA, 290 bp, Zea mays
  misc_feature: Incyte ID No: 700380827H1
gagtcccgaggccgacgccattcctgattcctccatcttccgttccgccgcacacgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaaggcatcccgcgaaggattagcctatggaaggttttacagtgtcattggtggag

SEQ ID NO: 6911 - DNA, 289 bp, Zea mays
  misc_feature: Incyte ID No: 700380828H1
  unsure 95, 205: a, t, c, g, or other
cttcaggcttggagaaagaagaaaggcatagcagcgggcagcggcatgggcaccagccccgtcatccctgcgacgatgtcttcgtcgtcttcttntcgctgtctgcttcggcgccaccgccgccaggtccagccacgcccgccacaccgacgccgacgacgcgattcgtctccccagcagctttggcgctggtggtcgaccgtgnaattgctgcgactccgctatcaaggacgcctccctgccggcgtggcgctgcaacgacgtggtggacaagtgctccgccgactgc

SEQ ID NO: 6912 - DNA, 233 bp, Zea mays
  misc_feature: Incyte ID No: 700380830H1
  unsure 19: a, t, c, g, or other
ctcttttttgcgtctaatnttctgttttacttcaaagtttgcaggtttgtttcagccctgtttgattgtgagccttggcgctggcggtattttttctaagtttaaatgatccacctgctgtaggtaagtttggttaaaagacattcctatttttctgtttagtgatactgatattagtaatccttttttttcatccatctatttaagtgtcagcagaatcgtttgttaaactt

SEQ ID NO: 6913 - DNA, 293 bp, Zea mays
  misc_feature: Incyte ID No: 700380831H1
  unsure 114: a, t, c, g, or other
aagaacaatatgttgtatggaatcaggattactcgtctgccaagaattctgtacatactgatcatgttgcagctgttgagaaggtgtcagaagacattgagaaggatttggttnttttgggtgctactgctgtagaggatagattgcaaaatggggtccctgagtgtatttataaacttgcacaagctggaattaagatctggattttaactggagacaagttggagacagctgtaaacataggttacgcttgtaacctactgaggaaagagatggaggaaatttttatcaca

SEQ ID NO: 6914 - DNA, 296 bp, Zea mays
  misc_feature: Incyte ID No: 700380832H1
  unsure 167: a, t, c, g, or other
ctcaagaaaatgactggcttcaatgccttttggtttacgcaccacctatttgttattgtgtatgcactgctcgttgtccatggggatctgcttatatctaagcaggaaatggtataagaaaacgacctggatgtaccttgctgtccctgtgctcttgtatgtaagtnagcgcattcttcggctatttaggagccatgacgctgttaggattcagaaggttgcagtgtatccggggaatgttttggctctctatatgtctaagccacctggattcaggtaccggagtgggcagtata

SEQ ID NO: 6915 - DNA, 215 bp, Zea mays
  misc_feature: Incyte ID No: 700380833H1
  unsure 175-176, 179, 188, 191, 195-196, 198, 206, 212-213: a, t, c, g, or other
ttttattctctattctatcctgggtctgcctcaaccgtgagataggagagtctctggtactagctgctgtagcagtggcccttcatccagggcagttaatggagtcttggaccctttctttctctgggatccctgcccagcaccttcctatagagatgactttaaaaggaaaaannaanaaaaaaaanaancccnntngttttaangggttnngg

SEQ ID NO: 6916 - DNA, 286 bp, Zea mays
  misc_feature: Incyte ID No: 700380835H1
  unsure 54: a, t, c, g, or other
cgattcgaaccatccagtctccgtgtccagtcgagtctcagcaaggaagatgtnggggaaaggaaagaagcgtttcgggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatc

SEQ ID NO: 6917 - DNA, 282 bp, Zea mays
  misc_feature: Incyte ID No: 700380839H1
  unsure 183: a, t, c, g, or other
gcctacaaggaggaggctgccggcgcctttgatagtgacatgtcacgctcacggggctacgccggcttcggcagcggcgctgcgccccgtaaccaaccgccccggttggaagtctggagactggatctgcaccaggtccggttgcaacgagcacaacttcgctagcaggatggaatgtttcangtgcaacgcgccacgggactccggtagcgctgccacgacgacctacgaaaactacttgcactgaggtgtaggtagagcaaagtttacagctatagcgcg

SEQ ID NO: 6918 - DNA, 283 bp, Zea mays
  misc_feature: Incyte ID No: 700380842H1
  unsure 46, 153: a, t, c, g, or other
attagaggctcgcctcttgagcaggaaggaagcagcacttaaacanagggaggctgcgctaaaagctgcaagagaatcagaggatggcagagatggggaagtaacaacactaaggcaagaacttgagtctgccaaagaagaggttgcatcagnaatggaccagctaaaggaggcagagtctgaaacgaaggctctccgatctatgactcagagaacggtcttaactcaagaagaaatggaggaggttgtcctaaaaagatgctggcttgcacgctattggggc

SEQ ID NO: 6919 - DNA, 284 bp, Zea mays
  misc_feature: Incyte ID No: 700380844H1
aaggggacatcttcacaggtacaagctgcacagcagctcatccaggactcgttggctgcacaccgagaacctgtcagaagcagttatgtgggagcaggattagattcactgtataggtccagctactcacaatatggcagctccacctatccttcgtcatcactgccatcttattctagcatcgatgatgttagtaggtacccatcttcaggtcttggtggctatgggtcgagttacaggtactagtactagttcgtccttaggcttgaatgcttgatggcacc

SEQ ID NO: 6920 - DNA, 125 bp, Zea mays
  misc_feature: Incyte ID No: 700380846H1
  unsure 16, 38, 51, 56, 59, 62, 66, 68, 70, 92, 106, 108, 115: a, t, c, g, or other
gcagaaccagccattnagctggattgtagtcacatatnccacttacagtgntgtcncgngantatnananaatcgatggcttggcccaaggntaacatttggattnanatcttgncccatttgca

SEQ ID NO: 6921 - DNA, 284 bp, Zea mays
  misc_feature: Incyte ID No: 700380847H1
  unsure 79: a, t, c, g, or other
ggtgcaggcgcgcatccgggcgcgccgcgtgcgcatgtccaccgagggccaggccgtgcagaagtgctcgaggcgcganccacccagatggatatcctcagggaagccgaggtctcaattgccttctccttttctacaagatgattctggcctggttctcaaacgcatcgggtagaagacgaacagaccctcattgctgctgtaatctctctctttcccaggaaggatggtgtgacagccagggaacacttgaacaagtgagggtcaagctgcagaagcggcag

SEQ ID NO: 6922 - DNA, 165 bp, Zea mays
  misc_feature: Incyte ID No: 700380849H1
  unsure 14: a, t, c, g, or other
tcgagcggctcgtnggccacccgtcttgttgaggcccctaagaccgacctggacttctggaaagttcttttcccggttgctgtggcgcatacaattggccatgttgctgctacagtgagcatgtctaaggtggcagtgtcattcacacacataattaaaagcgca

SEQ ID NO: 6923 - DNA, 321 bp, Zea mays
  misc_feature: Incyte ID No: 700380850H1
  unsure 281: a, t, c, g, or other
cagacattgcagcacactttgtgtcaggggcagttcctgagtcagttctaatgtcagatgattttgtgctcgcatcgtgtgctttcataaactgctctggagtgctcaagtgttttccagtagcacccactacattgctagcagagacagtaggacctccactgggtgcatgtagagcagagtcaacatgagattttgtgctgatctctctaataggggtcttctgtcaatacgtctgctacttaatgagcctgtaccagcatattctgtttcatctcagngtccttagctgagctcccattatctctacttcccaaccat

SEQ ID NO: 6924 - DNA, 164 bp, Zea mays
  misc_feature: Incyte ID No: 700380851H1
  unsure 22, 60, 64, 76, 83, 85: a, t, c, g, or other
gcagctacctgcctcccttctngcacccaccgctgccgtcctgcccagatcccgctcgcnggtngtgctcccctcnccccgcncngctggcgccgccggagcgagggggactgcccaaaccctagtgggagttggagactaggaggaagggcgcgagatccggc

SEQ ID NO: 6925 - DNA, 321 bp, Zea mays
  misc_feature: Incyte ID No: 700380852H1
  unsure 283: a, t, c, g, or other
tcatgattacattagtgttgagtcaaatgggacacgagaaatgaatgaccagcttggaacatcagaaagttccgcagaaagttcaaacttcggttcaagtactgaagatgtttccagtcctaagagagctagagctgaaaataattccatcataaaaaaatactgtgatatgggagaagctattggagaaaatgagccatgcactttgttgcctacagcctgtaacctactaccacgccaagctaatctgggtgaggtatcacgtgcccagcgcactattgangccgtggagaagctgttgttgcaggggatgggttcatt

SEQ ID NO: 6926 - DNA, 317 bp, Zea mays
  misc_feature: Incyte ID No: 700380853H1
aattaagcaggcttacaatagggcacaagtgaaaagggatgtagaaacaatacttactatgggaataatggaggatgttacgataattccacaaccagttggagattctagtaaagtggaccttgtcatgaatcttgttgaacgcccttcgggtggtttctctgctggtggcggaatttcaagtgggataacaaatggacccctttctggacttattggcagctttgcgtattcacatcggaatgtttttgggaggaacaagaaattaaatctctctttggaaagggggcaaatcgattcaatatttagattgactt

SEQ ID NO: 6927 - DNA, 318 bp, Zea mays
  misc_feature: Incyte ID No: 700380854H1
caatggaatgttgcggaccaggaggctgacagaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcagg

SEQ ID NO: 6928 - DNA, 321 bp, Zea mays
  misc_feature: Incyte ID No: 700380855H1
  unsure 13: a, t, c, g, or other
ctcagctcgacgngttcttggagatccgtccgtcccgggatcatttggcgcggaggtttggcctgggaaaatggcaaacatacgtgcacttctggtcggcttatcgcgggcaaggggatccttagcagaggctggacgatgtgcttccacgaggccatcaattctagcatctctgggcgcacattacaagatccccatgccagcccgctggttctcatctacagggcttcctccacatctggtggtcggaatgccagcactatctcctactatgaatcaaggtaacatcgcgaaatggagaaaacaggaaggggacaaggt

SEQ ID NO: 6929 - DNA, 317 bp, Zea mays
  misc_feature: Incyte ID No: 700380857H1
  unsure 189, 296, 313: a, t, c, g, or other
caccagcaagccaatcatcagatggtctgcctgacatccgtcctgctttcagacatgaaatgagaacaatggtgaaagaacagcagaagagtagtcgcagatatggtgtgatcaagtgtgatccactggtccggcaaggcttggatagaacagcaaagcacatggtcattccgtacatgcctatgttgnttcccccaatctgttggacaggatatgacaaaggagcacacctctttttaccatcatatgtaatgcgcacccatggtgtcggcaacagagggacgctgttaaaagantccaagggaacagatgntttt

SEQ ID NO: 6930 - DNA, 320 bp, Zea mays
  misc_feature: Incyte ID No: 700380858H1
  unsure 256, 293, 319: a, t, c, g, or other
gccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcangttttacagaaagtgcctgacaaactgcccatatttngcactgaccatgcattcaactacaang

SEQ ID NO: 6931 - DNA, 317 bp, Zea mays
  misc_feature: Incyte ID No: 700380860H1
  unsure 168: a, t, c, g, or other
gtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataaganaaacagagtcactctggatttcaaaaatgtcaaaaaatgagcaacagagggtcctatttaaacataagtgctgtgacttaggtgaattttcaatttaaggtagaaaataagtttttaggaggtttgtaaaagaagatcattttcagcag

SEQ ID NO: 6932 - DNA, 316 bp, Zea mays
  misc_feature: Incyte ID No: 700380861H1
  unsure 2, 9, 11, 17, 166, 170, 193, 252, 305: a, t, c, g, or other
cngctcgancnttttgntccgtctctcttcctcctcacttcccacccaccctcgcacgttttgttctgtctctgctttctcctcactccctccgtcgatcctctgcagcttgcatcggtcgaccagtagtcttccactgtaatcgcctctcattattctttctgcnacgntcctcttcgtccttactccctcngtcttgtctatctgtagccacttcgtcttcctacgtttttgccaggatttgaggctgtnatagtatgctctctgaccgtgctggcgggaggaaggagatgatttaagtctcngcgtttataac

SEQ ID NO: 6933 - DNA, 184 bp, Zea mays
  misc_feature: Incyte ID No: 700380862H1
  unsure 78-103: a, t, c, g, or other
atccatttcggcatttccaacgccttcgccctaccagccacgtcgtttcgaggccgatcgaccgagcagcagcagctnnnnnnnnnnnnnnnnnnnnnnnnnntcgtgctgctggacttctgggtgagccccttcgggcagcgctgccggatcgcgctggcggagaagggcgtggcctacgagt

SEQ ID NO: 6934 - DNA, 184 bp, Zea mays
  misc_feature: Incyte ID No: 700380863H1
  unsure 118: a, t, c, g, or other
gctgaacggcggcggcgagctgttcaggcacaggtatcccaagctcagagttcgcctcgtcgacggaagtggcctagcgactgctgtggtgctcaggagcatccctcgtgacgcgaanaggttctcctccacgcgggcccttctaagatagcgtgcgccacggccgctgcgttgtgcgagaggg

SEQ ID NO: 6935 - DNA, 184 bp, Zea mays
  misc_feature: Incyte ID No: 700380865H1
  unsure 182-183: a, t, c, g, or other
tcatctgaaagagatatttgggaactttggtgaagtggtgaatgtggagctatcaatggaccgaatggttaaccttcctcgtggctatggatatattgaattcaagaagagagctgatgctgagaaggctctactttacatggatggtggtcaaattgatggaaatgttgttaagttgaggnnc

SEQ ID NO: 6936 - DNA, 320 bp, Zea mays
  misc_feature: Incyte ID No: 700380866H1
  unsure 311: a, t, c, g, or other
ttggaggagaatccaacagctggcggcgcttttaatgttattcagatgaaaagcctggaacatcttatctctgcaccatctgctcagccaaacacaccagatttgccagatgaaaagaagcaatttattccttttgcatctccaccgccagttgttgctactccattggaaaaaactgagacagttccctcaccttcaatgtctcctccagtgaagccaacagagccaaaaatctccacaaagcgggttgatgaattggccacacctccagtacctcccactgattatacgttcacaaaacaaccagaacnagtacggct

SEQ ID NO: 6937 - DNA, 222 bp, Zea mays
  misc_feature: Incyte ID No: 700380867H1
aaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttctt

SEQ ID NO: 6938 - DNA, 314 bp, Zea mays
  misc_feature: Incyte ID No: 700380868H1
aaaaggccaaagtaatgattgagatacactgtctccacttgctttgattttgttgtttcattttataaaaggtagaaaaaattttggaaatgtcattgtcagttatttggcctgcagcactgtcttggggtgaatggatgtagccttcatgtaaaaacactgtgtggagcagctttatctgcattcaaacctcaaggtagggatgagggactccccagacatttctctggtgcttttctgtccagggtaagccacgaggcattgtcatctcagggtagtgcaccgcacatgctcacacctaggcttacccaggg

SEQ ID NO: 6939 - DNA, 313 bp, Zea mays
  misc_feature: Incyte ID No: 700380869H1
atatatctatctggaaattcactcaccgggaacatacctggatggttattaagaagaaacaagatcgcggacatatcttttaataacttcacgatggggagttcaggtccgagccaatgccttcaagggagtgtcaatctggtggagagctattcagctgaagtgaaccgtttaaatagtattcatccatgcttaaagaggaacttcccatgtgttgcttcgaatggacaatatcactcttcactgcatatcaattgcggcgacaaagaagcaactattaacggaactaaatatgaagccgacacaacaccca

SEQ ID NO: 6940 - DNA, 315 bp, Zea mays
  misc_feature: Incyte ID No: 700380870H1
  unsure 261, 277: a, t, c, g, or other
acatcaccagcatcatatgcccaaaatggtcttggaaactatgctggacgtgaacacgtatccctgcgatgttcctagaggaaggtacaagacgactagtttgcctgttcctggtcttggttcaagcagaggttatcagttgttgggtggctcatataatggaaaccatgatatgatctcaaccaataccccacaaaacatggctggaattcagacaggaccagcttggcttgaaagtgacgctgaggcaagcacatattnggaatcaaaggatgangttcatgatttggcaagcctgcgacatgcagttcttga

SEQ ID NO: 6941 - DNA, 315 bp, Zea mays
  misc_feature: Incyte ID No: 700380871H1
  unsure 35, 37, 39-40, 42, 114-115, 143, 225: a, t, c, g, or other
gatgctctgcgattaagcccagctaaactcgcgcngntnngntttggcgcacgctgggagctctcgagacgctcgcttggcgccgaagcggacgaggagcagttgtcggcgtcnnctgccgtgtcctcagctccgccatctcnttctccagctcgacgatcctctgcttcctgctcgtgaactccagcgcggcaggtcgagctcggcgcacagccacccgttctnggcttccacccgctctgcgtgttccctgcacctctggagctcggtcttcttggccgcgagctcggcctccaggactgcgccaaagccaaa

SEQ ID NO: 6942 - DNA, 314 bp, Zea mays
  misc_feature: Incyte ID No: 700380873H1
atccgaaagcttgtttggtgcaatgtggtttatgccatggaacatctggtgcttttagaaagactgtgaagggtcaatgggttcatgctttctgtgctgagtggctgttggagacaacattcagaagagggcaacataatccagtcgacggaatggagaggcttcatcacaaggataaagatacatgctctatatgccaccgctgtgttggtgcatgcttgaagtgctgtacattagattgtcaagttacttttcatccttcatgtgctagagatgctggtctttacatgaatacaaaaagattgggtaatatg

SEQ ID NO: 6943 - DNA, 314 bp, Zea mays
  misc_feature: Incyte ID No: 700380876H1
agcgcgcacgctctcctgggctatagcaaccgccgtcgccgccccacgctacgtgctcgagtctagcctcgtcggttccttcgtcagttcttcgtcggatcctttgctggcgaccaacacccaccagcttgctgtttcccccttctttttgcttgcttcatcgaagtcctttccaggatgaattctaagcgtaggaggagtcatagcccagttgaatacaaagaaggtcgtgaaaaagattatgaggcttctggaaggaaggataaatcaagagatctagatgacacatttgatgctaaaagaggtcatgaatc

SEQ ID NO: 6944 - DNA, 130 bp, Zea mays
  misc_feature: Incyte ID No: 700380879H1
  unsure 2, 7, 32, 42, 52, 66, 73, 105, 107, 127: a, t, c, g, or other
cnttgangggaactgtgatgataactttggtnttgataaganaatcggtggnattacatctgatgncattacngcagcttctgggggtatccagtaccatggagncngcaagtaacaaacttgatcntcc

SEQ ID NO: 6945 - DNA, 215 bp, Zea mays
  misc_feature: Incyte ID No: 700380882H1
tcaagtcaaataacatacttcttgactccaacttcgaagctcatgtggccgactttggtcttgcgaaattcttgcaggactcaggggcatctgaatgcatgtcagccatagctggctcatatggctacatagcgccagaatacgcatacacactgaaggtcgatgagaagagcgacgtctatagcttcggcgtcgtgctacttgagctcgtcacg

SEQ ID NO: 6946 - DNA, 310 bp, Zea mays
  misc_feature: Incyte ID No: 700380883H1
  unsure 32, 293: a, t, c, g, or other
caagaggaaaagcagcaccggatacgacagtngcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccanaaaaggtgtgggccgca

SEQ ID NO: 6947 - DNA, 309 bp, Zea mays
  misc_feature: Incyte ID No: 700380884H1
  unsure 27, 58, 85: a, t, c, g, or other
agcggcggcttccgcgactcgcccgtntcgaccgactcctccgaccgctggtcccgtnccgcgccgagcaatgaacgagcgtganaagcctcgcatcgtgcttgatccgcccaaacgtgacgcctcggccacccctacccctcctgctgaggcaggacgcagccggccgagcccatttggagccgcgaggccacgggaggacgtgctggccgataaggggctggactggaaaaagatggaaactgagattgatcagaagaggactagccgacccactagctcgcagtcgagtaggacagagagtgctca

SEQ ID NO: 6948 - DNA, 306 bp, Zea mays
  misc_feature: Incyte ID No: 700380885H1
  unsure 37: a, t, c, g, or other
gtatctcctgccggagcatgctccaggagcaaagcgngtatccgtaccagagagcctgtggttatttctctatcaaaccatcagcgagaaggttgatgatgttgttacttttccatcagactgtcaaccatgcaaaatctgtagtcaggaattgtctgatgttgcttctgttgagggtaatcttagagcagtaaaacttgagcaacgacacaaacatgaaaagttaatatctgggaagagctttgcacttcgtcctggtgaaaaatattatttggttccttcatcttggttgtcagagtggagagc

SEQ ID NO: 6949 - DNA, 306 bp, Zea mays
  misc_feature: Incyte ID No: 700380886H1
  unsure 9: a, t, c, g, or other
atgctcgcntctcctctcctcacatttccggctcccctctccgcattccatggcaccgcattaccggtatttttagccgccggaggagacgggttgcgtagagagaggggaaaccagagctcctgactgttcctctctccctcctcacgggcgggctccgtctgttccgtccatccaccgccccggtcgtctcccggccagatccctctctgcaagtttctttgcgagtggccggagaagatgatgggcgggttcctctccagggtcctcctgctggcttttggctatgcctatcctgcctatgaa

SEQ ID NO: 6950 - DNA, 307 bp, Zea mays
  misc_feature: Incyte ID No: 700380888H1
tcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaacactactcttccaaggataagtcctatgccgaagaaagagaccggcggaaaagtctag

SEQ ID NO: 6951 - DNA, 248 bp, Zea mays
  misc_feature: Incyte ID No: 700380894H1
tcagttggaatcaagcacaagaagattaatgtctcaaatcccagagtagcatgggaacacgaacagttctcaaggtttagggtgactgcacttactctttcagaaatgtctacccctcctgaatttttggaaagcactggcggtcttcatgacactagagaatctacagatgctgagtcagtaatccgagctgccagattagtttctgagagtcttgcgagacgcatctatggactgaagggaaggat

SEQ ID NO: 6952 - DNA, 306 bp, Zea mays
  misc_feature: Incyte ID No: 700380895H1
  unsure 297, 301, 303: a, t, c, g, or other
aaagtttggtatcttgcttgggatagaccttagaacacctagcacatctgtaagaacggataaacaagctgctgaaatacttaagagcccactggtgagagactcaatgcggggggcagcttttttgtcaagctcagtggacatgatgtcccctaagaatgaaacgtcgaatttggaacttgcatatgggcttcagaggggacctggcatgggattgtcaagctggtctcagggtatgcagctaccaaatacacagctgcagagctcaagcaatagcctacttgagcagagtgcaanattnanctc

SEQ ID NO: 6953 - DNA, 320 bp, Zea mays
  misc_feature: Incyte ID No: 700380901H1
  unsure 66-67, 76, 80, 89, 109, 151, 163, 188, 201, 206, 244-245, 253, 280-281,: a, t, c, g, or other
gtggtactgtcccaagtgccggggggagaacgagaagaccatggacaaagccctggagaaatccanngaagagagngctnacaacaggnagtttgtggacaggcgcctngtgttaggaggacaaaataaaccgtgtatttattacattgcngcctttgttgangtgcaaggagtgtaaaatgtatatntttaaagaatgtnagaanaggaaccattcctttcatagggatggcagtgattctgnntgcctttngtcttcattggtacacgtgtaacaagnnagggtctgtggatcngctttnagaactacantatagttt

SEQ ID NO: 6954 - DNA, 140 bp, Zea mays
  misc_feature: Incyte ID No: 700380902H1
  unsure 27: a, t, c, g, or other
atccgccacttctgattcatggcgtanagttcaaagaacaccaaaaaaatacatattaatgacttcgacaatttccattatcatgcacaaccaagtccagtacctgcatcaatattgcaattagctggctcagcatattg

SEQ ID NO: 6955 - DNA, 313 bp, Zea mays
  misc_feature: Incyte ID No: 700380905H1
accatctccacaacccgacagttggaagttagctgagatttttgcaactggagtagttcttggtggttatttggccatgatgactgtcattttcttctgggctgcatacaagactgacttcttcccgcgactgttccacgtcgaaagcctcgagaagaccgcccaggatgactttcagaagctggcctctgccgtgtaccttcaagtcagcacggtcagtcaggcccttatcttcgtgacgcggtcgcgcagtggtcgtttgtggagcgtcctgggttcttgctggtcttgctttcttggtggctcagtgatc

SEQ ID NO: 6956 - DNA, 138 bp, Zea mays
  misc_feature: Incyte ID No: 700380906H1
tttatcctttccgtaatctctttttaaccctgctgactattacagggcttgtttaatcacagtggcaagaattacatgtatcttacagtaaagaaacagaatactggaatcgttagagaaccctgatgtgttgacctg

SEQ ID NO: 6957 - DNA, 317 bp, Zea mays
  misc_feature: Incyte ID No: 700380907H1
  unsure 37, 172, 175: a, t, c, g, or other
cccagttcgaggccgctgcgcggccctgcgcatgctnctggcagatcagggccagagctggaacgaggaggtggtgaccgtggagacgtggcaggagggctcactcaaagcctcctgcctatacgggcagctccccaagttccaggacggagacctcaccctgtaccagtcnatnaccatcctgcgtcacctgggccgcacccttgggctctatgggaaggaccagcaggaggcagccctggtggacatggtgaatgacggcgtggaggactccgctgcaaatacgtctccctcatctacaccaactatgaggcggg

SEQ ID NO: 6958 - DNA, 139 bp, Zea mays
  misc_feature: Incyte ID No: 700380908H1
  unsure 35, 92: a, t, c, g, or other
cgcatccgcatcttcttccagagcaagtcgagcgnggcggccacaaaacccagtcccatacgcacccgtccgttccgcgcgatcagccgagngatgtcgtcgtcggcgcccgcaccggccgccatggccgtggacgacg

SEQ ID NO: 6959 - DNA, 126 bp, Zea mays
  misc_feature: Incyte ID No: 700380909H1
  unsure 56, 91: a, t, c, g, or other
gcgcgaactccttcgtgcgcaggaggaggttaagcggatccagtctgtaccgctcntcattggccagtttatggagatggtcgacggcaanaacggcatcgtgggctctaccactggcagcaacta

SEQ ID NO: 6960 - DNA, 310 bp, Zea mays
  misc_feature: Incyte ID No: 700380910H1
  unsure 296, 308: a, t, c, g, or other
agtgtgcaggcccgtcgtgcacaaacccgtacaagtaccgcgactccaagacgctgctccctctctgcagcctggcgtgctacaaggctgtccagggccgccctcctgaccagcgaaccgacgctgcccaggggagtggaggtggccaggaaagcgctgggaagcaagcatgatgaatctagctacctgacgcgattgaaccgtgaccgtcagttggctggagaagtgtatgttaacatgtccagtcgttgtgtgtggtttctttggcggtatctaacaaccacctgacaaaagtngggtgaccgctncc

SEQ ID NO: 6961 - DNA, 161 bp, Zea mays
  misc_feature: Incyte ID No: 700380911H1
  unsure 53, 146, 159: a, t, c, g, or other
caaagtccaaaccctctccccgccgcatcgccgccgccggaagcgcctccctncgatccagatccaggagatatgccttcgcaatgatgatcgctatgggaatacacgcttgtatgttggaagattgtctccccgcacccgttctngtgactagaatantt

SEQ ID NO: 6962 - DNA, 136 bp, Zea mays
  misc_feature: Incyte ID No: 700380913H1
  unsure 16, 19, 48, 52-54, 62, 68, 75, 83, 86, 94, 120, 125: a, t, c, g, or other
ctcttgtctgatctantgnatgggagccgtatcttgatattcttccanacannnaaggattncgatangatcacncggcagcntanaatggatnggtggccagcattatctatacatggngatanagctcaagctg

SEQ ID NO: 6963 - DNA, 305 bp, Zea mays
  misc_feature: Incyte ID No: 700380914H1
  unsure 6, 14, 42-43, 80, 219, 228, 236, 250, 254, 265-266, 279, 284, 287, 297,: a, t, c, g, or other
ttcgtnccgctgcngccgcgaccagctgtggcttcatcagannatggtgactctgatcagatgatggacctgcgcaagtngcggcctttgcactcggacaagctcaagcccggctctttgcacatgaaggacgaggtgatccagctatacctcaacaattcggcagcagttgcggcaccaagggaggtgtgtttgcttggtgccctcaggtgtcatggnatcgggatnttgtagancttgggatttccanggancattgaagggnnccctctggaaagnaattnaanttttgggggnacnncctc

SEQ ID NO: 6964 - DNA, 305 bp, Zea mays
  misc_feature: Incyte ID No: 700380915H1
  unsure 2, 111, 114, 116, 131, 133, 146, 178, 181, 192, 198-199, 209, 219, 224,: a, t, c, g, or other
cnagcaagccattgttgacaagaatcctgttgttgccagtgcagcccttgttagtggcatctacttgcttcaaacaagtcccggaagttgtaaaaagatggagcaatgaanttnancaggctgtgcagtanangagctgctcttgngcagtttcatgcccttgctctccttcaccaanttngacaaatgacngcctgnnggaaagaaanctgtcatagnttgancgggggttaaattncccnccttggcccaaggcnnantttgngnaannggccnggttnnaaggnnnnggngannnagggggg

SEQ ID NO: 6965 - DNA, 311 bp, Zea mays
  misc_feature: Incyte ID No: 700380920H1
  unsure 189, 242-243, 256, 278, 283, 293, 310: a, t, c, g, or other
gcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgtcatcactgngaccatccccagctgccgatgcctatgcgatgatagaagaatgtgggaaacgnntttccagggatgnacgaggagaagcatgtgatgangatgnacgagtccangagtttcttgatatggng

SEQ ID NO: 6966 - DNA, 128 bp, Zea mays
  misc_feature: Incyte ID No: 700380921H1
taatgttacagatggtttggatgagaatacagatgatgattctactgatgaagatgacttggatcaagatgatttcaacaaaacagtcccgaatgagacaaaaggtggaggcaaaacagaaactacta

SEQ ID NO: 6967 - DNA, 313 bp, Zea mays
  misc_feature: Incyte ID No: 700380922H1
  unsure 72, 309: a, t, c, g, or other
gcggagtctagactcgagagcaacctcgacctcccggatctctctcccacccacgcctcgtcggcgccgtcntctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcggccgctacttcgctgcaggccgtgaagttgctcgcntgta

SEQ ID NO: 6968 - DNA, 122 bp, Zea mays
  misc_feature: Incyte ID No: 700380923H1
  unsure 20, 27, 29, 36, 39, 68, 74, 89-90: a, t, c, g, or other
tcctaggggagtaggcaagnacttccncntaggganggngtgggggaaaggaatgacacatgacgtanctggcntacacattaagcagnngatcatatgtctgactgggttccagtttcttg

SEQ ID NO: 6969 - DNA, 132 bp, Zea mays
  misc_feature: Incyte ID No: 700380924H1
  unsure 128: a, t, c, g, or other
gaggcctgctgggaacgggacttctaaaaggaactatgtctggaaggctgtggtccaaggccatttttgctggctataagcggggtctccggaaccaaagggagcacacagctcttcttaaaattganggtg

SEQ ID NO: 6970 - DNA, 299 bp, Zea mays
  misc_feature: Incyte ID No: 700380926H1
  unsure 162, 185, 269, 296-297: a, t, c, g, or other
tatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattatgtcttgatgttgtnccctggtgctgattatgtctgtnaatcctgggtttggtggccagagctttatcgagagtcagtaaagaaattgcagactgagaagttatgtgcagagaagggagtanccccggatggaggtgagggggttgccnnaa

SEQ ID NO: 6971 - DNA, 309 bp, Zea mays
  misc_feature: Incyte ID No: 700380927H1
  unsure 44, 46, 49, 116, 134, 141, 162, 165, 167, 178, 221, 248, 252, 256-257, 271,: a, t, c, g, or other
ctttcagcactatccagcactttcagataaacacaaggcaagcngntanagcttaccatacactgggctcaaattattttacatgactttatcccaggtcaaatttactgaccgantgaataatctcagatcanatttatngattgcctttcttttcacagngtngnatctgcaacgnatttgtacctgtcatgaaagccatgtggcctggtttatatggnaatgctgggggtagcactcatgttatntcanaganncggaaacttgcggntcaagctctcgttcatgtgcaaatngtgcaaacccatt

SEQ ID NO: 6972 - DNA, 298 bp, Zea mays
  misc_feature: Incyte ID No: 700380928H1
  unsure 272-273, 282-283, 286, 291-292, 294: a, t, c, g, or other
cttcttcccgcggtctgctcgttcgatctgtgcagcagatctacggtcccgggcgaccgtgaagcagcttcaatccgtcggcatggcgctcgtattgcatagtggggctggaaacaagaatgccttcaaagcacttattgctgcagaatacagtgggatcaaggttgagttgaccaaggattttagatgggttccccaacaagacccctgagtttcttaagatgacccccttggaaggttctgttcggaaacccgagggccttttttaaaannaaccaaccnnccnttttnncnggaa

SEQ ID NO: 6973 - DNA, 303 bp, Zea mays
  misc_feature: Incyte ID No: 700380930H1
  unsure 8-9, 13, 150, 152, 174, 187, 189, 191, 270, 283: a, t, c, g, or other
ggcgaacnncgtngcagcgcggcccatggcgaagcagggggcgaagaagatgaaggacgagaacaagaagcgcttggaacttactcctgcgcatcatcctcatatccaacgttatttactagtggtgaggatggctataatgcttctgcntncaccggaagcattggattggcntatggtaacatcngncngatattttcttcctataagcaactcgccagtatggcaaagccagtttactctgataacggagaactactggatggtggntcgatttgagcanggtggggttgcgagtattta

SEQ ID NO: 6974 - DNA, 284 bp, Zea mays
  misc_feature: Incyte ID No: 700380931H1
  unsure 39, 176, 188, 203, 219, 228, 233, 245, 267: a, t, c, g, or other
taaagctcctccattgcgccaccgccactctcctttcangaggaggcggaccaggtaagcagcagcaggaaccctagcaccgccgcatccgcagccatgggtatcgacctcgttgccggtgggaggaacaagaagaccaagcgcacagcgccgaagtccgacgatgtttatctcangctccttgtcangcctaacggtttttngtcagaaggaccaagngcaattttnatgcngtattctcaagnggttttcatggcaaaaccattngccacaatttctggggg

SEQ ID NO: 6975 - DNA, 127 bp, Zea mays
  misc_feature: Incyte ID No: 700380934H1
aacagtcaaaatgaccaggtccgacctctactgagtttattggagaaagaaccaccttctcgacatgtatctggacaacttgattatgttcgccatatatctggtttggaaaggcatgaaaccattc

SEQ ID NO: 6976 - DNA, 308 bp, Zea mays
  misc_feature: Incyte ID No: 700380936H1
  unsure 31, 34, 110, 161, 163, 173, 192-193, 197, 199, 268, 280, 307: a, t, c, g, or other
ctagaagttttgaactatttgggtgcatagntgntgaaggtaatctgacacattagtgagatggatgagcgagtttccccctggatcccacaaatgtcgaagatgctctncatgcagtgccaaaataacaactgttcgaatgaaatgttatgcagtcatgngnccatgctgtncagcacccaattgcttgcnncggncntagggatgctcaaaaggctgctgatgaggcgaaggcgcgatttggccacttgacggggacctctgacgntctgaatgtatncctcgctacaaacaaaacaatgaagtnc

SEQ ID NO: 6977 - DNA, 299 bp, Zea mays
  misc_feature: Incyte ID No: 700380938H1
  unsure 56, 96, 100, 113, 172-173, 235, 255, 259, 277-278: a, t, c, g, or other
cattgtcatccagtagtcgcactgcagggccaaggattcttgtacagtacgccgtncaggcttacattattttggttccttagatcagcacccatncatncatgttggctgcngcccctcaggtgctgccattcgagaaccttttggcttttatcagaatcgccagagactnntatatgaagcaactcaagtttgggaatctgggtaatgttggtatggtagaaacggggaggcntcatggcgggcaggctagtncagntcgtgaatccggttctcnngattggaatcgacagataacg

SEQ ID NO: 6978 - DNA, 154 bp, Zea mays
  misc_feature: Incyte ID No: 700380939H1
  unsure 53, 59, 63: a, t, c, g, or other
cttggcgtagaagagttggggcgcagaagaatccccaaagcaaaacaaaacancggtangagngtaagaggggagagggagagggagaggaagagggagagggagagggtttggggttctggggaccaccatgggctcccgattgaaagctgta

SEQ ID NO: 6979 - DNA, 125 bp, Zea mays
  misc_feature: Incyte ID No: 700380941H1
  unsure 2, 30, 39, 64, 68, 74, 84, 108: a, t, c, g, or other
anggaggcaaagcaactggctggggctganaaagtaagncactcgaaacaaaccttgcatcaanaccnagcaancaattttagncagcaagggatggtcctaaagccngtcgccagctagagcag

SEQ ID NO: 6980 - DNA, 295 bp, Zea mays
  misc_feature: Incyte ID No: 700380945H1
  unsure 12, 17, 22, 25, 54, 60, 62, 85, 98-99, 122, 146, 150-151, 218, 226, 252,: a, t, c, g, or other
cagatctacaanaaggnatgangantgctggagtcggcaggcagatgtacaatnaatacnanatactttactttcaatatctaanacaagataatttnngagtgcaaaaataacgtatagtncagttcacagcatatgtggaaggnaaanntctgataataattcaaaggatgggagggaagtggaagcttgatgtcagccgctgccatggatactgnagtgtccnctagtgttaaaggttgcggcgtgaanttnnagtgggatggnacnccnagacncgntggncggcacatnc

SEQ ID NO: 6981 - DNA, 93 bp, Zea mays
  misc_feature: Incyte ID No: 700380948H1
  unsure 7, 9, 38-39, 51, 72-73, 75, 80: a, t, c, g, or other
gcgggcngncgactgcaggcagagggtttcgtccgaannctagtgtcctcnacacgccgtcgccatggccgnngnccgcnccgccctccgcct

SEQ ID NO: 6982 - DNA, 316 bp, Zea mays
  misc_feature: Incyte ID No: 700380949H1
  unsure 180, 315: a, t, c, g, or other
gtcggcgggtgagctgcggttggagctggacgagctgcggcggctggagagccttcgccaagcacccccgcgtccagatcctcctcgccaacgaaatccgcaacgttgaagcgaagttggcgaaggcaaccgaaccatcgcctgagccactggcggcggcttctgcgccaggcccgcgcncgctgcgcgtcctgttttaagctacgtcactcttgggtcgttcagtgggagcaggacaacgagaagattaggatatatgtttcccttgagggagttgaacaagagaaggtggagacactttcaagccacattcang

SEQ ID NO: 6983 - DNA, 310 bp, Zea mays
  misc_feature: Incyte ID No: 700380950H1
  unsure 90, 232, 251, 265, 299: a, t, c, g, or other
caatcttgaacctgacaaagtcatcatgtttgtcgagaacagacctttcaatgaccagaggtatttcttggacgatgagaagctcaaganccttggatgggctgagcgcaccccatgggaagaaggcttaaaaaaggcaatggagtggtatgtagcaaaatctgattattggggtgatgtttctggggccttactgcctcatccaaggacattgatgatgccagggtgcganggctcagaggagattaaangaatactcagccgnttaataacatcaaacaaaggtcggttcaacatcngataatgcccc

SEQ ID NO: 6984 - DNA, 312 bp, Zea mays
  misc_feature: Incyte ID No: 700380951H1
  unsure 39: a, t, c, g, or other
acatgcttagcacgcatgatctggttgaagctgtcagancacgcagcttcagaatgtgccgcgtcactgatatccgagtaccaggaaggactgttgaagatcggtaaatatgcagcacgctatttggccgtacggcagaggagattgtcgctcgctgccaaactccggtcggaagatcggtttatggatgttgaagacgacagcgtttcagaaacgagcactagcttcagtgaaatgagcgcatataccacaagggagtcgagcgcttcggtcatgtccagcaacgtcagcaaatcgcgggcggcgaggcgg

SEQ ID NO: 6985 - DNA, 309 bp, Zea mays
  misc_feature: Incyte ID No: 700380952H1
  unsure 16, 19: a, t, c, g, or other
cggaccggcggcgganggnagatggcggagaagaagcgaggcgccggcactcgcaaggatgaggtggtgacacgcgagtacactatcaacctccacaaacgcctccacggatggtattgccccaaaccgccccaacctccttccattcccaagcttcgcgtggcagcagagtagatccgcttgttggagagcatatcgttgttctatatctgcgttgggcttgcatgtgcgatgctggtgcggagggttgcggcctgtgagcactctgtgggcttgcgattggttgatatacctgattggatccagtat

SEQ ID NO: 6986 - DNA, 201 bp, Zea mays
  misc_feature: Incyte ID No: 700380955H1
  unsure 55-56, 65: a, t, c, g, or other
gtggaagaggagagaagactgaagagaagggaagacatggccgtgacggcggaanngcggcaganatggtgttggagcggcgggcgtacgcgcgggtggggctcctcggcaaccccagcgacgtgtacggcggcagggccctgtccttcgccatcgccgacttttccgccaccgtccacctccgcccttcgcccgagctgt

SEQ ID NO: 6987 - DNA, 307 bp, Zea mays
  misc_feature: Incyte ID No: 700380958H1
  unsure 3, 61, 299-300, 306: a, t, c, g, or other
cancccggtacgtagctagcagtgactgtcgcgtggacgtgtccggtgcgggctgcgagtnacgtgggctaaataaagtgtgcgtcgggtggtaatggtggtggggcccggtgtcagtgcgcgcggtgccccatgcctgccgcggctgcagcttgttgtgtcttgtgttggttgagttcctgttctttctgtctatctattctcacgcatggcagtttgggtatggtatgggtcgtcttctttggttacgttctgtttgtgtcattgtgtgatgatatgatcttctttatataataatnnagccanc

SEQ ID NO: 6988 - DNA, 307 bp, Zea mays
  misc_feature: Incyte ID No: 700380959H1
  unsure 15, 64, 203-205, 286, 300, 302: a, t, c, g, or other
gaaatctcgtctcgnccaagagctgaagctgatcggcgagtatgggctccggaacaaacgtgangtctggagggtcaaatttaccctggccaagatccgcaaggccgcccgggaactgctgacgcttgatgagaaggacccacggcgtctgttcgaaggcaacgccctgctgcggcggctggtccgcattggggtgctggatnnnggcaagatgaagctggattacatcctgggcctgaagatagaggatttcttagagagacgcctgcagacccaggtcttcagnctgggcttggccangnccacc

SEQ ID NO: 6989 - DNA, 148 bp, Zea mays
  misc_feature: Incyte ID No: 700380960H1
  unsure 4, 76, 81: a, t, c, g, or other
agangaatgggcctttctgccataattcttcactagtcaagaatgccagcagtttctttgtataaagagacctgcntttanaatcatacattctgaacattttagtcaagctacaacaggtttggaaaacctctgtgggggaggggcg

SEQ ID NO: 6990 - DNA, 305 bp, Zea mays
  misc_feature: Incyte ID No: 700380961H1
  unsure 103: a, t, c, g, or other
gcgcggtggagacgctgtgcggcaggcgtacggcgcgcacaagcaccgcatgctgggggtgtacctgcagcgctcgacggtgctgctcatggccaccgccgtnccgctgaccgtcgtctacgccttctcggagcgcatcctggtcctcctcggcgagtcggagcgcatctccagggccgccgccgtcttcgtctacgggctcatcccgcagatcttcgcgtacgcggccaacttccccatccagaagttcctgcaggcgcagagcatcgtggcgcccagcgttacatctccgtggccagctggcg

SEQ ID NO: 6991 - DNA, 309 bp, Zea mays
  misc_feature: Incyte ID No: 700380962H1
  unsure 243, 259, 274, 280-281, 284-285, 302-303: a, t, c, g, or other
gttgatcttagtactgctggaacttatctaaacaaaaacttttctgatataagcacagagcaaggttggagaacaacacacaaccacacaagtaaattacccatttcgtttatgggtaatataactagcagttccggatgggaatctggatcttctaccacacgatctaatcaaaaccatggatctgctggaggcaatcatagctctgttagtggagcaaacataatagttcctgataagatngggaataaaacaatantgcttggtagagaanggagannacnnacctcaacttcttcggnngggggg

SEQ ID NO: 6992 - DNA, 311 bp, Zea mays
  misc_feature: Incyte ID No: 700380966H1
aattgactgtgcccagctctcgatctactccaccctttaagtaaggcaacttcagttggcagacctggcaatgacaagctagaaggttaccaggcattccccctcccccaaaatgattgcaacgacatcgcactgagtaccaagtatcagagtaggatgatgtattcccctccgcgcaccgatcccgacagagaggaagagcagtgcttctcaatcggaagtaatctgcttgcttcactagaccattaccataccatggattttgatgagcctgtcgtctccccaatgaccaatgcaggcatgcaagaggg

SEQ ID NO: 6993 - DNA, 306 bp, Zea mays
  misc_feature: Incyte ID No: 700380967H1
  unsure 109-111, 130, 152, 160: a, t, c, g, or other
cgctggtgaacaggacccgtcgccatgggccgtgtgatccgtggacagaggaagggcgccgggtctgtgttccgcgcgcacgtgaagcaccgtaaaggcgctgcgcctnnncgccgtggatttcgctgancggcacggctacatcaagggcntcgtcaangacatcatccacgacccgggccgcggcgcgcccctccgccaaggtggtcttccgggatccgtatcggtttaagaagcggacggagctgttcattgccgccgagggcattcacacgggccagtttgtgtattgcggcaagaaggccc

SEQ ID NO: 6994 - DNA, 304 bp, Zea mays
  misc_feature: Incyte ID No: 700380968H1
ctttatctttatctttactccgatctttatgccgatgttagtgtttcttctgctccttctccttgtctctatctttctctttgtgtttcttatgtttcttcactttatccttggacttgaccttggatttcccagatatggttggtgtacctttttcagcagaaggcaagtctactggtgcagtttctcgcagctgaaatgcttgtcctagtgtttccatgtcaaatggctgaatgtaagcagtcttctcacttgaacatgagttctgaaagagttggtccaactccatcccttcccccttagg

SEQ ID NO: 6995 - DNA, 305 bp, Zea mays
  misc_feature: Incyte ID No: 700380970H1
  unsure 127, 279: a, t, c, g, or other
gaagccctcagtcctccctcacacaccgaaccgagcgcaccatgtcgtcggcggctggaggagtggaggagacggtgcgggcgtcgcacatcctcatcaagcacgagggttcccgccgcaaggcctncctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgngtggggattaggtactttgggaggag

SEQ ID NO: 6996 - DNA, 304 bp, Zea mays
  misc_feature: Incyte ID No: 700380971H1
  unsure 301: a, t, c, g, or other
tttcggaacaaatgggtggtgttagttatcttgagtatctgcgggacctggaaactaagattgatcaagattgggacagcatatcatcttcactcgaggaaatgagaaaatcactcttttccaagaatggttgcttgatcaaccttactagtgacgggaaaaatcttgaaaaatcaaggcaacatattgccaaatttcttgattcactcccaagtagcccatccattggaagtgatccatggctttctcgtctaccttctgtgaatgaagccattgttgtcccaactcaggttaattatgntgg

SEQ ID NO: 6997 - DNA, 302 bp, Zea mays
  misc_feature: Incyte ID No: 700380973H1
  unsure 18, 63, 162, 167, 201, 213-215, 235, 244, 255-256, 270, 286, 300-301: a, t, c, g, or other
gcgctcaaggagccaganagggaccgcaagaaggtcaagaacatcaagcacagcggcaacatncagcctgcgacgacgtcatcgagatcgccaggaccatgaggcacaggtccatggccaaggaattggccggcaccgtcaaggagatcctcggtacctgcntcagntcgggtgcaccgtcgacggcaaggaccccaaggncctgcagcaggnnnttgacgacggcgaggtgganatcccgtcngcttaagaagnnttggtctccaggantgtgttattttgctgntgaaccttttctgnnt

SEQ ID NO: 6998 - DNA, 193 bp, Zea mays
  misc_feature: Incyte ID No: 700380976H1
  unsure 36, 51, 109: a, t, c, g, or other
gtctcctccccacctctccttccctccacccgtgcngtcgcctcgcctatncgatctgccacctgcctcccgtctcgcacgttccttcccaactccgcagcgtagcctnctccgcggcgcgatccagatccaggtttttcagcatgggcctggtgaaggaaggcatcgacatggaggagggaacccttgagat

SEQ ID NO: 6999 - DNA, 300 bp, Zea mays
  misc_feature: Incyte ID No: 700380977H1
  unsure 291: a, t, c, g, or other
ttgaattagtcactgtcagggagggatctagttgtcggttgtttgtattaaagctgctggcactttccttgcagggtatctgtagaataaatgggagaagcacacttggatgaatgttgtcattgccaggggtgtgctggcaagtatacactactcagagatgaagaaaacccacggtggacaatctttgagaggcggcttccttgctgtggttgtggtataggatggtcttcttttcttttagggttcttgtgtccttgatttggtactttgcagccactctttactgcngcaatacta

SEQ ID NO: 7000 - DNA, 170 bp, Zea mays
  misc_feature: Incyte ID No: 700380978H1
  unsure 79: a, t, c, g, or other
ggcagctctagctttgcagtcgtgtaattggcccaagtcattgtttttctcgcctcactttccaccaagtgtctagagnccatgtgagcctcgtgtcatctccggggtggccacaggctagatccccggtggttttgtgctcaaaataaaaagcctcagtgacccatgag

SEQ ID NO: 7001 - DNA, 66 bp, Zea mays
  misc_feature: Incyte ID No: 700380979H1
  unsure 38, 57, 60: a, t, c, g, or other
cgatcccacaggatccgagagacctcacaagcccaggnccccatcgcggcgcctgcnagnccccac

SEQ ID NO: 7002 - DNA, 243 bp, Zea mays
  misc_feature: Incyte ID No: 700380980H1
  unsure 87-108: a, t, c, g, or other
cctcatgcagggcctcaaggcgttcaagaaccagcacggcaacaagcaccagctccctgagctcagctcggacgacgatgacctgtnnnnnnnnnnnnnnnnnnnnnntttgacgacgactacgaggaggagctccgcttcctcggggacaagatgagccagctcgggttccacggcaacaaccagaacaagaacgggaacaacgtgctgtcaacagtaaccacagcaacggaaatggcaaga

SEQ ID NO: 7003 - DNA, 304 bp, Zea mays
  misc_feature: Incyte ID No: 700380981H1
gaagcgtaccagaaggtaaatatcaacgtggaggaatactgggatgccatactgtttttcagatctctgaagttggcacagcttgatataaaaggaaatgcagttgcaagcaaggagaacttcagaactattgtcatgatgctcattccttgtctaaaatggtttgatggtgaagatgtcaattaaaatggagttgagcaatgatagtgtcaaggctcacgctgtaaaccattttttgctagaaggcattgatttgcatcatatgtactgctatatttgtttaaaaaactcggccggtagggga

SEQ ID NO: 7004 - DNA, 206 bp, Zea mays
  misc_feature: Incyte ID No: 700380982H1
  unsure 190, 193: a, t, c, g, or other
aagcaaggtgccggttgtacaatctctgatcagtgtcttttcagcactttgagcatttacttggctcatttagtcttccttttgtagcgcatggttgggaggaaaaagtgcatgcatcattcctcactcttctctttttcccgcccccccctcccttcgcacataggcatttggtttgcttccatctttnttnatgcagtgcctgt

SEQ ID NO: 7005 - DNA, 290 bp, Zea mays
  misc_feature: Incyte ID No: 700380983H1
  unsure 29, 264, 271, 273: a, t, c, g, or other
gtgaatttgttattaagcatttgattttntgtgatccctaaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacatttngtaaaantntttataaaatgttttgt

SEQ ID NO: 7006 - DNA, 297 bp, Zea mays
  misc_feature: Incyte ID No: 700380985H1
  unsure 230: a, t, c, g, or other
caggaacgacaggcaattcgaggcgggcaatctaatcgtctgccatcccgtctcatcgttctcccaaatctgagagcgttcccaggacctagggttcttgagatccagccccaggatggatccgaaccctagagctcccctcctcctcgccatcgtcgttctcgcgcttggcgtatccgtggtggccagcgccgaggacgacgcgtcgggggtctctctgggccgccgcnccggggggttcttgcacggcctgaagaaggatgcactggcggagggcgatcatggggtggcatagac

SEQ ID NO: 7007 - DNA, 295 bp, Zea mays
  misc_feature: Incyte ID No: 700380986H1
  unsure 91, 101-102, 121, 129, 163, 188, 191, 243-244, 260, 271, 276-277, 280-281: a, t, c, g, or other
agctgcagttgaaattgtttaaaaagtagcaggtacaatgaatattgtcacagatgtgttaatttttgaagcaatgtgggtgctgactacncgtagtatcnnaaatatgttcaggattgtnttgatacntgtatttataataaaaaatgttggggggagttgntgaattcctgttaaaagctgttctngtncgttacatgtaacagacatggtaaatatttgtttacagtctttgtttaacannccatgcattaagtttnagtgaggtcancaaannggnntaggtgtatggatt

SEQ ID NO: 7008 - DNA, 185 bp, Zea mays
  misc_feature: Incyte ID No: 700380987H1
  unsure 100, 154, 177, 182: a, t, c, g, or other
aagaaccatttcttgtttttcctagataattctctaaaaatatgattcttccatatagaatgctaagcttatttttacatgcagtttctagctccttcancccagctgaggtcgtgccagggagacagagtctggagaagggcagaggaatttnggaaggatccctggctcatagtngggangcg

SEQ ID NO: 7009 - DNA, 295 bp, Zea mays
  misc_feature: Incyte ID No: 700380989H1
  unsure 287: a, t, c, g, or other
agcgtggactactccctggcgcactgatccaggtgatcatcctgctcgccaccggggcaagaacggcggcggctacctggcgtccaagtacatggtgatcggcttccacgccgccatcctgctcagccacgccgtcatcaacagcctccccatcaccttcctctcctttttcggccagttcgccgcggcctggaacatgctaggtgtgtttgtcctgatggttgccgtgccgaccgttgccaccgagagggccagcgccgagttcgtgttcacccattcaacaccgncaacggcg

SEQ ID NO: 7010 - DNA, 297 bp, Zea mays
  misc_feature: Incyte ID No: 700380990H1
gctagtgcactggtgtcgctcgcaaccaaattaaggactgaggcatggcatccaagggcgtcctcttcttggctctcaacctcctgttcttcacagtggccaacgcctgcggcagctgcccgaccccaacgccgccggtcgtgccaccgccgccgcctcctgctgctaccccacccccttcatcatccagtgggaagtgcccgctgaacgcgctcaagttcggcgtgtgcgtcaatgtgctcggcctcgtcaaaggcgaggtggcaaggtaccagctgagccatgctgcaactcatg

SEQ ID NO: 7011 - DNA, 297 bp, Zea mays
  misc_feature: Incyte ID No: 700380991H1
  unsure 234, 252, 254, 271, 283, 290, 292, 294: a, t, c, g, or other
cacatattgaaatagcaaatagaaatgtgcaggagcggagagacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagngccatccagacacactcncnctctcatctctttcctnggctggaaacangtgcagncncnccc

SEQ ID NO: 7012 - DNA, 298 bp, Zea mays
  misc_feature: Incyte ID No: 700380992H1
  unsure 191: a, t, c, g, or other
gcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcaggnccatcagtacattgtcaccgatgacaaggaaggccccaactgtgaactggagaagcacattgaagacatgcatgtctgattaccaccccattccacccagcttatgg

SEQ ID NO: 7013 - DNA, 299 bp, Zea mays
  misc_feature: Incyte ID No: 700380993H1
  unsure 100, 112, 212, 253: a, t, c, g, or other
gtgcaggaatgtctctgagctgttcacgttgatgcttcttggttggcaagacttgggtgtagacatgaaaccatcttactaaaagcgtcttaaaatgacncattccagaatncaagcgtattccgttttcttcctgcatgatccctgggccctcccgcaggctgagcaagtctgtaaactgattctgggagaaaccaagctgctggccgtangatgtccttgggtacatccaggagtcttcattgcttctgtnattaccccgtctcctctgccattttctacagcttgctgagttgtca

SEQ ID NO: 7014 - DNA, 107 bp, Zea mays
  misc_feature: Incyte ID No: 700380994H1
  unsure 65-66, 106: a, t, c, g, or other
cccgccaacatgggccgcgttcgcaccaaaaccgtgaagaaggcggcccgggttcatgcatagannagtactacacgcgcctgggcaacgacttccacagcgacana

SEQ ID NO: 7015 - DNA, 298 bp, Zea mays
  misc_feature: Incyte ID No: 700380995H1
  unsure 25, 68, 225, 236, 246, 266, 272, 277, 283, 286, 295: a, t, c, g, or other
agacccttcacattcccagttcccnctgcgccccgtaaaccctagccgcgattcatggcccgcaagcnccgcgcgccttcgcctcctccgcctccgcaggagaagtcgtcctctgaggaatctggctccgaagagttggaggagcctcctcgcctccccgagctccgtagtcctccgcaggccgcggccaacaacgccgactcgtcggaggcggacacggactcngacacggacgntaaagtttcnagatgcgcgaggtgccccgntccttnactangcatangcntcgattccnggc

SEQ ID NO: 7016 - DNA, 156 bp, Zea mays
  misc_feature: Incyte ID No: 700380996H1
  unsure 30-31: a, t, c, g, or other
gattatttctgtcccacatgaacggatgannttggaaaaaaaaattgtgaaggattttgatttgtttaggattagagggaattaagtttggcttgtacataaatttaaattaaacgacgcttattctaggagggcgtatctatatgtcatgtgtgc

SEQ ID NO: 7017 - DNA, 297 bp, Zea mays
  misc_feature: Incyte ID No: 700381001H1
  unsure 220, 266-267, 277, 289: a, t, c, g, or other
ggctttgctctgcaaccatgagctccctgtacgacgtctcctgcttcgccgctggccttgctggcaacgtcttcgccctcgccctcttcctgtcgccggtgccgacgttcaagagggtcctcaaggccaagtcgacggagcagttcgatgggtgccctacctgctgtccctgctcaactgtgcatctgctctggtaggcctccgtggtctccgaggcggnaggcctcgtcgcaacgtcaactgaacgggcctgttcagctcgctannctggtctcanctctagcgaagngacatcgt

SEQ ID NO: 7018 - DNA, 309 bp, Zea mays
  misc_feature: Incyte ID No: 700381002H1
  unsure 72, 178-179, 182-183, 191, 213, 226, 275: a, t, c, g, or other
gccgccaaggtgctcggtccttccgaggaagctaaggctgcgttggggtgaggccctcacttcatccggcgnctagcaccgcgtccggcagcgccagccctacactcgcccgcgccatggcctctgtctccgagctcgcctgcatctactcggccctcattctgcacgacgatgaggnnacnntcacggangataagatcaatgcctcattanagcagccgtgtanatgttgagctttttggcctggctgtttgcaaaggcctggcaacgtcatnatgggagctcatctgcatgtaggggccgtgactg

SEQ ID NO: 7019 - DNA, 315 bp, Zea mays
  misc_feature: Incyte ID No: 700381003H1
tgcctccccaactattggttcaaaaatatcaagagcaagtagagccagtgcagctactgtgcatggaaatgagaatgatgttgaagagctagagatgttgctggaggcatatttcatgcaagttgatggcacattaaacaaattgacaacgttaagagagtacatcgatgacacggaagattacatcaatatccagcttgataaccaccgtaatcagttgatccagctagagttattcttgagttctggtaccgtctgtctgtcgctgtactcatagttgctggagtcttggtatgaatattccgtatacctgga

SEQ ID NO: 7020 - DNA, 310 bp, Zea mays
  misc_feature: Incyte ID No: 700381004H1
  unsure 111, 237: a, t, c, g, or other
ctggagttggtcagcagctgttctatggtcagccaccaccagccttcatcaaccctcaggctggatttgctttccagcaacctctgatgcctggtatgaggcctggtggtncaatgccgaactttatgatgcctatggttcagcaaggacagcaaccacagcgtcctgctggtagacgtgctggtggaatgcagcagcccatgccaatgggtggtcagcaacaggtgttccctagangtggtcgtggctatcgctatcctatggacgtggaatgcctgatcctggcatgcacatgttggtgtgtgatgcc

SEQ ID NO: 7021 - DNA, 311 bp, Zea mays
  misc_feature: Incyte ID No: 700381005H1
  unsure 87, 254, 276, 286: a, t, c, g, or other
cggcgtgagaagccatgagcagcaaagtctctcgcgacaccctgtacgaggcggtgcgggaagtcctgcacgggaaccagcgcaagnccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgttnatatcccccacatggactcgangcgctgaaanaatcaacaagaataaaaaactggtc

SEQ ID NO: 7022 - DNA, 308 bp, Zea mays
  misc_feature: Incyte ID No: 700381006H1
cttctcttgtggccacgacgagcgacattcgctactcgctaccgtcctacgccaggtgccccaggtcttcttcggttccttcgccggcgacgaacgctaccagacatgtaaatggctgcccactgcactactgcttgattggctggttgctgctctctgcaatttgggctgctctctgattgattcggtattgtagattgctgagaactcaatgtttgatttctaattgtgcagattagacttcgcaaaaagaacttgatcttatatgcaaacttcaagatgttctctgctccaggcaacaatattgg

SEQ ID NO: 7023 - DNA, 255 bp, Zea mays
  misc_feature: Incyte ID No: 700381007H1
gacgatgcttccttcagcgatgacctgggatgcgacttgtactccctgggtgcctgtatatgatcgctaccttccacgtatctgcatctgtgttaatctcccattgtatgctgtgcagctagtgttaatcttaggtagaattgtagctgtgcgcctatctttgcttgctcacagccaagaaaaaaaaaattgatgtctgcacgtgatgtgctagcagtaagatatctggatttgtggaagtcaatgcccattgct

SEQ ID NO: 7024 - DNA, 306 bp, Zea mays
  misc_feature: Incyte ID No: 700381008H1
gccgtccgtccgtcgcctgaacaggaagtgttgctccggagcaccggctagccgccctagaggatcgacaagatggtgccaattccagtgactccctgaaattgggatgttggatcagatcgatccagtatggcaacacagggacaacatatatcctggattcaagtgcaagtactgcaaaaaacagtggaaggatgtggtgctatacgtttcaagcaacaccttgcatcgtgtggggggaatgtgcaaggttgtcgcatcgttccaccggacatgtcgattactttcagcaggagttgacaagtc

SEQ ID NO: 7025 - DNA, 302 bp, Zea mays
  misc_feature: Incyte ID No: 700381009H1
  unsure 42: a, t, c, g, or other
gttattttacctgataagttatttcaaccctttggcaattgnccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttctactcactcttctcataaaataggaaatatttagttctgtttcttggggaatatgttactcttaccctaggatgctattaagtgtactg

SEQ ID NO: 7026 - DNA, 305 bp, Zea mays
  misc_feature: Incyte ID No: 700381010H1
  unsure 297: a, t, c, g, or other
cttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaactcctgcccgaggtgctccgggacggggagctgtgtcgccggccttccctgctgcggcancaccccct

SEQ ID NO: 7027 - DNA, 304 bp, Zea mays
  misc_feature: Incyte ID No: 700381013H1
gggaggccgcacgcagccatgggatttcctgcaggagcaaagcgtcgagaccacagtggccgtcgccgtcgctgtcgccgccgtcgccgcagggcgccttcctcctccttcgatccaggaagcccaagggctgcttggatcctgagaacttcaggaagttcaaacttgttgaaaagaagcaaataagtcataatgttgccaggttcaagttcgctcttccaatccaattctgtattgggccttccaatcggtcaacatatcagtgcagaggacaagacgctacaggtgaagaagtaatcaagcc

SEQ ID NO: 7028 - DNA, 302 bp, Zea mays
  misc_feature: Incyte ID No: 700381014H1
  unsure 13, 114, 133, 136, 146, 213, 223, 296: a, t, c, g, or other
gtgctgcactcanatgatgggaagtccggccccagtacacaggggcttgactttttcaacttcgtttcctttgttggagtcaaaaagaaccacttgtggttctaaaaggtgtgnaggtgatttaagggcccangtnagccactgtntgtttacaaaatcaggtaactaactgcatacactttttctctttccatgacatcaagactttgctanagacatgaanccacgggtgccagaagctactgcgatgccccgggagttagccccctggtaatagctgtatacttccaatttcnagcata

SEQ ID NO: 7029 - DNA, 305 bp, Zea mays
  misc_feature: Incyte ID No: 700381015H1
  unsure 3, 39, 61, 81, 107, 116-119, 218, 301-303: a, t, c, g, or other
gcnagccacagacccctgggagcttccgctttgaaagangcaagacacgtggcctcgtgangggcaagctaggccccagangccctggaggtctccaggggcctgangaaggagtnnnnggggccctgctacctgttcttgggcctcaggctctgcacagtcaagcagcccttgctttcggagctcctgtccaaaagtagggatgcggatcctgctgnggccgccatggcctggctggtgggaaggccggcagcgggcggaggggatccagccattccccctcttcttctgaagatcagannntc

SEQ ID NO: 7030 - DNA, 308 bp, Zea mays
  misc_feature: Incyte ID No: 700381016H1
  unsure 41: a, t, c, g, or other
gtcgcttccagccgccgccgcgtccgcctcgccaagcgcanagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgcttacaaattccctcatgatgcacggcgcaacaag

SEQ ID NO: 7031 - DNA, 307 bp, Zea mays
  misc_feature: Incyte ID No: 700381017H1
  unsure 55, 62-63, 241, 266, 275, 291, 305: a, t, c, g, or other
caagggcacaacttgcctgcaatgagctcctgctcaactacttctacttgttgangctcagnntccacagtgggttgctcgtctactcgcatcaacacaatacatacatagtatagccaaaatcaacatcacaccaaacagatgaatgaaatatacagtaaaaatctacacattaaaatgagagcataggaactggaatcactaaatttggagttataggttcaagttatgaatttcctangtttaatgtgattaaattaggatantgttaattntgtctatcagggtccngtcaaacaggactnaa

SEQ ID NO: 7032 - DNA, 305 bp, Zea mays
  misc_feature: Incyte ID No: 700381018H1
  unsure 23, 26, 58, 83, 180, 239, 245, 289: a, t, c, g, or other
tcatatcagtccgcttgacttangcnccaaatatgctgataaactgggaccaggcttncaggagtactgcaagacatacccanaaaattattgcttagcccagcttatctattggtatagccagaattcagaacctgaatctagattaacaagagctagaaaaggttgcatgtcgttgcnagatgtctcatccttctatgtgaagtctgcaaaaccatcacaagagcgagcttatgganacagantgtgagattcagttatcgcgcatggaaaagcaggtacaagaccnggccacagataggatt

SEQ ID NO: 7033 - DNA, 308 bp, Zea mays
  misc_feature: Incyte ID No: 700381019H1
ctagcaaaaagatggatttctgcacatctattttcttcatttatctcagaggaggcagttgagctggtagttgcacatatatttttgaagccattcccattccatgccccatcttctcgggttgctgggtttctcaggtttttgcggttgttatccagttttgactggatcttttcacccatggttattgacataaataatgacttcaacctgatggatgagaaggagatcaatgataactttatgctgagcagaaaatctatgagcgaaacccccatgatatagagcctgcaatgtttctgctacgt

SEQ ID NO: 7034 - DNA, 308 bp, Zea mays
  misc_feature: Incyte ID No: 700381020H1
  unsure 4, 9, 12, 14, 16-18, 24, 26, 30, 35, 61, 111, 114-115, 131, 182, 204, 223,: a, t, c, g, or other
cagncttcncgngncnnngagatncntccnccttngtcgccgcgtccttggctggcgtcanaaaaatggctacaaacttcctagcacatgagaagatctggttcgacaagntcnngcatgacgacgcaganaggagattctacgagcagatgaacgggcctgtggcaggtgcctcccgccangagaacggcgccacgtgatccnccgtgacattgcgagagcnagagagaacatnnagaaatcgctggctggangttcaggcncgggncgtccagcggcaccagcggagaccacggtgagtcgtcgtc

SEQ ID NO: 7035 - DNA, 299 bp, Zea mays
  misc_feature: Incyte ID No: 700381022H1
tcacaattacaagcaaaagagatcctgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcataccaactgccttgctccattgccaaggttgtccagaggaattggcatcgtggagggcctat

SEQ ID NO: 7036 - DNA, 302 bp, Zea mays
  misc_feature: Incyte ID No: 700381023H1
aagcaatagataagtgtattggtgatccagatgcagatgaggaaaaccatgttctgaaagctgaacaggatgcacagattggcaagggttctcgtggtgatgttaccatcttaccaactctggtaatcaacaatagacaatacagagggaagcttgacaaaggagcagttcttaaagcactttgtgctggctttagggaaaccaccgagccagccgtttgcttgagtgatgatatacaaacaaacgagtgcctagagaacaatggtggctgttggcaagataaggctgccaactcatgcatg

SEQ ID NO: 7037 - DNA, 302 bp, Zea mays
  misc_feature: Incyte ID No: 700381024H1
ctctgacaaagaaaatatagaaaatacagctttgaagcatgagcatgtcacaagcaaacctccatcgatactcatggtagaggcacgggtgctcgatttcaatgaatgctccacacctgtgaggaagaaagacgataagaaagtggaaatggttttaggaggacctgcaacatcccctgttacttcctcgcatctttggataaatatgcggtagccctttgaggtgagtgggagtggggatgctcgcctatgctgttcagtatgtacatgtctgttattcccataatttccaccgttttgaa

SEQ ID NO: 7038 - DNA, 302 bp, Zea mays
  misc_feature: Incyte ID No: 700381025H1
  unsure 2: a, t, c, g, or other
cncttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggccca

SEQ ID NO: 7039 - DNA, 301 bp, Zea mays
  misc_feature: Incyte ID No: 700381026H1
  unsure 72, 112, 187, 197, 199: a, t, c, g, or other
taccccgcagttcccggacatgatcctctccgcctctcgagataagaccatcatcatgtggaaactgaccanggatgagaccaactatggaattccacagcgtgctctgcgnggtcactcccactttgttagtgatgtggttatctcctcagatggccagtttgccctctcaggctcctgggatggncccctgcgcntncgggatctcacaacgggcaccaccacgaggcgatttgtgggccataccaaggatgtgctgagtgtggccttctcctctgacaaccggcagattgtctctgga

SEQ ID NO: 7040 - DNA, 302 bp, Zea mays
  misc_feature: Incyte ID No: 700381027H1
  unsure 3, 6, 9, 12, 59, 67-68, 72, 75, 82, 100, 102-103, 113, 129, 140, 154, 170,: a, t, c, g, or other
gcntcnacntgnacgacaacacataatgagccaccaatcacatgcctatcatatagtanaacccagnncatncanccctaanaggggccctctcagcccncnnaatgacctcnggcctagccatgtganttcacttccantccataacgctccncatacgaggcctactnancaacacactaancatataccantgatggngcnannnnngggaganagcacataccaaggccaccacacaccacctgtccnanaaggccttcgatacgggataatcctatttattacctcagaagtnttgg

SEQ ID NO: 7041 - DNA, 298 bp, Zea mays
  misc_feature: Incyte ID No: 700381028H1
acaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggt

SEQ ID NO: 7042 - DNA, 298 bp, Zea mays
  misc_feature: Incyte ID No: 700381029H1
  unsure 18, 69, 214-219, 261, 264, 280-281, 293: a, t, c, g, or other
aggatgaggaggatgagncggacaaggaggaagatgaggaggaagatgtccccggccaggccaaggacncgctgtagagaggcctgcctccagggctggactgaggcctgagcgctcctgccgcagagctggccgcgccaaataatgtctctgtgagactcgagaactttcatttttttccaggctggttcggatttggggtggattttggttnnnnnnccctcctccactctcccccaccccctcgccgccctttttttnttntttttttaaaaggggnntttaacttggtnccccc

SEQ ID NO: 7043 - DNA, 298 bp, Zea mays
  misc_feature: Incyte ID No: 700381030H1
  unsure 26: a, t, c, g, or other
aacggggccggccggccggccgaganatcggaactgaagtgtgggcacacaagagtcacaacagggagagtgggggacattcgaatcagttccctgcgtgtgagcgatgcagcgggacgcgagaagctggtcgccggcgccagccacggacgccgccggcccttacgcgatgccttcgcccgtgcagccgtcgaccaagagcacgaaggagacggtgaagaatgcgctgtcgcggtgggggcggaaggtcggggaagcgaccaggaaggcgacgacctgtcgcgcaccactggcagca

SEQ ID NO: 7044 - DNA, 296 bp, Zea mays
  misc_feature: Incyte ID No: 700381031H1
  unsure 93: a, t, c, g, or other
aatataatcatggatatcatgcagactagtgactcttcacatcatggaattgtagaaaatagcccgtacagaattccatatgacagacatgcncgaaggtggtcaacttggtgcttcatggtattttagtagaaaagaaatagaggagaattccctttcgaggagagacggcattgatctgaagaaagagtctatcttcgcaagtcatattgcacatttctgcaggatttggggatgagactaaagtacctcaagtgacattgctactgctatagtgttctgtcatcggtcttctc

SEQ ID NO: 7045 - DNA, 300 bp, Zea mays
  misc_feature: Incyte ID No: 700381033H1
ccattccctagcactgtccacgggcgaggtaaagaaaccatctttccaccttctcccaccccctccggacccataggtgccaccggcatttgtcttgcgattgcttggcccagatctgcgtgcattcggcatttctcgtgcgtagatctcgcgtgtacggtgtacctcgtttccctcggcgggtggatcagtgacggatggtcgagatggacgatgtggttgatgacatcatctgtggaacggatgcggcggttgccgtcgaggatggggcagtgggacgccgcaatgcctagcttaggt

SEQ ID NO: 7046 - DNA, 294 bp, Zea mays
  misc_feature: Incyte ID No: 700381038H1
agagtttctgtctgctaccagcaccatcctagcaccccaccgcgtctagggtttcctgctccaatggccgccgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctctgggccaatccggatccccgctgatcccactctccgattccgggagcccgagtgatgcag

SEQ ID NO: 7047 - DNA, 293 bp, Zea mays
  misc_feature: Incyte ID No: 700381040H1
ccagttcatgttgctgctgatctgctatcccaggcagaacatggtccagatagtcaggttgttctagttgttgctggagacggtgttgatctgggtgccattgaggcagaagttagcaagcagtgcaacgcgcttccaagaggtgaattcgcctcaaaagcacttagccacagcttcactgtgttcgcgaaagatatggttgaggcgatatcattctcaaatctgtatgcccctgagcattgatcatcaacgtaaaggatgctgagcagtgggaggagttcatcgaaaacgca

SEQ ID NO: 7048 - DNA, 285 bp, Zea mays
  misc_feature: Incyte ID No: 700381041H1
  unsure 76, 264: a, t, c, g, or other
aaacatttttgtgaattttaaccactttgttcttctgaacttcagagaaaacagtgattctgtgctacccaaactncaaagacttgcaggccaatcctccttctttgcatgtctcagtatataatgagatcaagagttctcttggagaggcatcaaaatctcctgggtttactgtgatcgcgggagaaattgactcaaatgttgctgctgctgatgatattgattgggacatttctgtggatactaatgaaattgattgggacntggtgctgtggaacaacctgg

SEQ ID NO: 7049 - DNA, 291 bp, Zea mays
  misc_feature: Incyte ID No: 700381042H1
gatttcgtcgcattcctgcgttctcggcgtcaaatcccctgtcctgagagctatgctggaggaagctagactgagagatgggtttcggtgtatccgtgtctctggcgcgccttcggaagcagtccgtgtcttcatcagatttctctactcttcacggtttgagcaggaacagatgaaggagcacgctctgcatttgcttgtgctctcccacgtcttctcggtgccgtctctgaagacggtctgcgtcgaccaactcgagaggggcttcctcgctactgacaagtggtagac

SEQ ID NO: 7050 - DNA, 290 bp, Zea mays
  misc_feature: Incyte ID No: 700381043H1
  unsure 121, 163-182, 221: a, t, c, g, or other
ggagacactctgttcaaccaccagccgagttcgcagcggcactccagggtccaggcccagcagcctcttacggctcttcgttgggggtgcgtggacaccggaaattgcctcggggattgcnttcctgatctaagcccggcatgaagggctgctcagagcgttnnnnnnnnnnnnnnnnnnnngcatcgtcgttgttactgtccgtcgtggttgccgcgcanagacttgccctgccgacctcgacagcaaatgcgacggtggcgcgcctgatgactgggagggggattctt

SEQ ID NO: 7051 - DNA, 250 bp, Zea mays
  misc_feature: Incyte ID No: 700381045H1
  unsure 8, 25, 40, 43, 62, 66, 74, 85, 94, 124, 131, 145, 159, 163, 169, 180, 193,: a, t, c, g, or other
agggtgcncggaggccacaagaggnggctcctggctggcntgnggctggccggatgggaagnggcnagcaggtntgtaaacaganggttccatnaggctggggcagggtggccgccttccgcanacttgangaaccctcccctcnccctcggtgacatnttgnccgccnctcagcacccngccttgtctctcngaggtncgaagcnctgtggnncctcttnggggcaaggtnggntnnncncatggagta

SEQ ID NO: 7052 - DNA, 294 bp, Zea mays
  misc_feature: Incyte ID No: 700381046H1
  unsure 45, 74-75, 77-78, 80, 120, 224: a, t, c, g, or other
ctatctaccactactactacccagcagcagcaggccagcacacantacacacactctaatctctccacacagcnnanncnggcaccggacaggacaggaggatgaagctgggagcaaaangcctcggcctcctgctcctccttgtcctgcttgcgctttgctccaccattgaagtcggcgaggcaagaagagaccggcattggaggtcgtcgaggacctcctcntctcagctgctgaagaaaggcaaaggaaagaagaccagctcccgccgccaatacggcagcaaccggccag

SEQ ID NO: 7053 - DNA, 294 bp, Zea mays
  misc_feature: Incyte ID No: 700381047H1
ctcagacagtagacttgcagacgttgtacaacatagaaggctgggatgcgtacgcgttggcttttcaggcgacggaagagcaggcacatcttcaattcatgaaccctggcatggaggatgatccaacttgtggtcctatcctagacaacgttgccgtcaagaagctcttcaccccagacaaaccaaaggataacgtggtgctgaatggagactttgaggagggtccatggatgttccccaacacgagcttcggcgtgctgctcccaactaaccttgacgagcaaagtctgccat

SEQ ID NO: 7054 - DNA, 196 bp, Zea mays
  misc_feature: Incyte ID No: 700381049H1
  unsure 41, 93, 100, 172, 192: a, t, c, g, or other
agagattcccctcccagccgtcgaaagtcgaaaccctagcnccgcctcaccgccggcggtggtggcagcctcagcaccggcacacagcccgcngtacctntcctcgtacgctccctttccggtgtgccgtcgccccctcgaccggtcatcgttcgtcggctcggtagccgcnggatcggatcgggatcggcnggcg

SEQ ID NO: 7055 - DNA, 211 bp, Zea mays
  misc_feature: Incyte ID No: 700381053H1
  unsure 5, 117, 157, 175, 179, 197: a, t, c, g, or other
tgtangcattcaactgatctaccaattgagaaaagtgctcgacatagtcagtaacagtggagtgttggcgaatgtgtaagagctgtctaagtaggtactcatattggtttttgccanaacgctcactgattaaccccccaaattcagaccatgtgangctgggtaatttgtgctntatncgactggagccagcgcgnggctgagcctgaaa

SEQ ID NO: 7056 - DNA, 329 bp, Zea mays
  misc_feature: Incyte ID No: 700381055H1
  unsure 41: a, t, c, g, or other
ctgtgacaaagagaggatgaaaggacagcaaggtgtaagcntagatgcattggtgggaatatttacccgttctgggtagagacatggaggagattggtgttagcaaaagctataagttagctgaaaaagttgcatctataatggaagaagcacaacctcttcttacacggattgaggcttagctgaagaaatgcaacctttgctctctgaggttaatgatagtgatctgctgaaggatgtggagactatagctaaaggcctggccgacgcgtctggtgacctaagaaggctgaagtcgtccatgcttaccccagagaacacagatctta

SEQ ID NO: 7057 - DNA, 328 bp, Zea mays
  misc_feature: Incyte ID No: 700381056H1
  unsure 95-96, 99-100, 198, 251: a, t, c, g, or other
gtaccatggccttaaacaaccttcattccgaagtaatcgaactaaggaacgaaggtcttgagaaagataaaatattaaactcattgctaaataanntannagaagacgaagctacttccaaagcccaagctgaagcccagaagtgcgaaattgaagatcttcagaaacagctagctgaagcgaagttaaagtgtgcanttgccgaagctgaccaagacgccataactattagaaaaattattgggagaagncagttgtagaactccggtcttcaaaagagactgctacgaaaaatccatagaatgtgtgcaaaaaaataatatctagc

SEQ ID NO: 7058 - DNA, 232 bp, Zea mays
  misc_feature: Incyte ID No: 700381057H1
gggatgacttgccagcttgttctaaacatgcagctagtggtaagttctggatttagatagtaataagtaatggggtgtccaccgtctaatatcgtcatgggatactaaaggtttttattctgggagatgtgacaaaccgcaaactctttggttaggggtcggtcggaactgtcctgttcgtctgttttatcctgataccggtgctgtgttgtgtatgtacataatgaagtag

SEQ ID NO: 7059 - DNA, 327 bp, Zea mays
  misc_feature: Incyte ID No: 700381058H1
  unsure 28, 162, 275: a, t, c, g, or other
gcgctctcttccaggacatcaagaagcnagctgaagatgagtggggtaaaaccccagacgccatgaaagctgccatggccctggagaaaaagctgaaccaggcccttttggatcttcatgccctgggttctgcccgcacggacccccatctctgtgacttcntggagactcacttcctagatgaggaagtgaagcttatcaagaagatgggtgaccacctgaccaacctccacaggctgggtggcccggaggctgggctgggcgagtatctcttngaaaggctcactctcaagcacgataagagccttctgagcccagcgacttctg

SEQ ID NO: 7060 - DNA, 324 bp, Zea mays
  misc_feature: Incyte ID No: 700381060H1
ggcaactgggcgaattcacatgttgcaaaattctctgcgatggattcaacttacagcttgcctgataatgttgcaatgcttacccttcaggagcttgaagatggaagtgttctccttcggtttgctcatctatatgaggccggggaggacaaggatctttcgtctttagcgagtatcgacctcaagagagtgttcccggagaagaagattggcaaggtcatcgagacaagcttatcggcaaaccaagaacgcgcacccatggagaagaagctttgaatggaaggcgcaaggttctgcggctgacgagaagtggttcggggtggc

SEQ ID NO: 7061 - DNA, 330 bp, Zea mays
  misc_feature: Incyte ID No: 700381062H1
  unsure 41, 225, 233-234, 239, 283, 295, 300, 307, 326, 328-329: a, t, c, g, or other
aagccaacaagcaagaccgaccgcttctgcttgtgacccgnaacctttcttcgaacgcaaaaagaaccccacccgacgtaccgcgagcccggctatggcgacggtggcgatggacatctcgaagcccacgccggcagcgtccggtgacgaggcagcggcggcggcgaaggggaggagcggcggcgggggcgaggggctgcggcagtactacctgcagcacatccntgacctgnngctcnagattccggccagaagacccataacctcaaccgcctcgaggccnagcgcaacgacntcaantcccganttagaacctcagggaagantnnc

SEQ ID NO: 7062 - DNA, 214 bp, Zea mays
  misc_feature: Incyte ID No: 700381064H1
  unsure 25, 108, 161, 192: a, t, c, g, or other
agttaggccttcttgtccgcttgtnttggcggcggcgatggcgacgtcggcgagcacgtccggcgagtggctcaagggcgcgctgcaggaacttcgggagcgtaaggncagctcgctggagttcgactcggatctcatctcgggcctcgtctccttctgcnagctcgcgcctccctccgacgccaccagctntctcgagaattttattgggaaa

SEQ ID NO: 7063 - DNA, 328 bp, Zea mays
  misc_feature: Incyte ID No: 700381066H1
  unsure 90-111, 119, 298, 316, 327: a, t, c, g, or other
gccagtacatggagggcttcaacgacgagctggaagccttcaaggagcgtgtgcggggccgtgccaagctgcgcattcgagaaggccatnnnnnnnnnnnnnnnnnnnnnncgcaagangcggctcggccccggcggcctggaccccgtcgaggaactccagaagtgcttcgatgtgaaggacgtgcagatgctgcaggacgccatcagcaagatggaccccaccgacgcaaagtaccacatgcagcgctgcattgactctggcttgggtccccaattctaaggccaccgaggcccanggaggaaaaggaaggaantctggggaccnt

SEQ ID NO: 7064 - DNA, 195 bp, Zea mays
  misc_feature: Incyte ID No: 700381067H1
  unsure 65, 184, 191-192: a, t, c, g, or other
gaaggccggaacccacctgctgcgcacctgcaagcctcgagtggagctcttccacggccgcggtngagatggcggcgaatctggaggacgtgccgtcactggatctgatgcacgagctgctccgccgcatgaagtgcagctccaagcccgacaagcgctcatcctcatcggtccacctggtatnaaaagannttt

SEQ ID NO: 7065 - DNA, 174 bp, Zea mays
  misc_feature: Incyte ID No: 700381068H1
  unsure 82, 84, 169: a, t, c, g, or other
gcaggctgagttcttgaagaaagccccaggagttaagcatgttgagagagacatgaaggtacagaaattgactacacacacncnctcaatttcttggattgccaactggggtatggtcaacaggaggtggacttgatagagctggtgaagatgttgtgatcggtatcgnggatt

SEQ ID NO: 7066 - DNA, 212 bp, Zea mays
  misc_feature: Incyte ID No: 700381069H1
  unsure 24, 84, 88, 155, 178, 180-181, 183, 196: a, t, c, g, or other
gggcggcgcgtggtctacgccgantgacagagacgctcaggctgtgttctcaggatgaccgagtgggagacagcagcaccagcngtgncagagaccccagacatcaagctctttgggaagtggagcaccgatgatgtggcagatcaatgacattnccctgcaggattacattgcagtnanntncgaagtatgccangtacctgcctcacagt

SEQ ID NO: 7067 - DNA, 323 bp, Zea mays
  misc_feature: Incyte ID No: 700381070H1
ggaagcaccaaagccaaagccaaagaatcctcttgacttgctgccaccaagcaagatggtccttgatgactggaagaggctatactcaaacacaaagactaacttccgggaggttgccatcaaaggtttctgggacatgtacgacccagagggctactctttgtggttctgtgactacaagtacaatgatgagaacaccgtctcctttgtgaccctgaacaaggttggtggattcctgcagcggatggacctgtgccgcaagtacgctttgggaagatgctcgtgataggctctgagccacccttcaagctgaagggctttgg

SEQ ID NO: 7068 - DNA, 325 bp, Zea mays
  misc_feature: Incyte ID No: 700381073H1
  unsure 30, 144, 223-224: a, t, c, g, or other
gaacggagagttcgacctagcacgcccggnccgccgccgcagcccgcaatggcgtcccttttcaaggaccccagcaagctctcggcgtacagggaccgccggttcaaggggacgcaggaggagtatgaggcggcgctgcttgcntcgacaacgctgtacatcggtaatatgtccttctacaccacggaggagcaggcctacgagctcttctcccgcgccggcnngatcaagaagatcatcatggggctcgacaagaactccaagaccccatgcggtttctgtttgtactgtactactctagggaggatgctgaagatgctgtcaa

SEQ ID NO: 7069 - DNA, 207 bp, Zea mays
  misc_feature: Incyte ID No: 700381075H1
acatttagctgcgtggagggaactgttaagttttgttgaagtgacggagacaaaaacctaaatggagtgggagagaaattggagacagaaagaacccttcagaggtctgttgtaaaaggatgcaaagaaacagggaactagaagggattgtggggtccaaaggagaaataccagcacgtttgtatgttgtcaataatgtttcagtag

SEQ ID NO: 7070 - DNA, 163 bp, Zea mays
  misc_feature: Incyte ID No: 700381077H1
  unsure 5: a, t, c, g, or other
aagcnacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagat

SEQ ID NO: 7071 - DNA, 176 bp, Zea mays
  misc_feature: Incyte ID No: 700381079H1
  unsure 61, 174: a, t, c, g, or other
gccgcgagctcctgcgtcaaccagatcacacgaaccaaaccagcgcctcatcccccgagtnctcaccgccagcgcccatggcgacacgctactggatcgtgtctctgcccgtgcagtcacctggcgccatcgcaagctccctgtggtctcgcctccaggactccatctcccgcnat

SEQ ID NO: 7072 - DNA, 177 bp, Zea mays
  misc_feature: Incyte ID No: 700381080H1
  unsure 79, 81, 89: a, t, c, g, or other
cgctcatccaggagtcgccggacgcgggggtcgtccagaaggtcgtcgaccttgtctactcctgcacccagcacgtccntnccggtgcnccccgaggatgtcgcacgtcgtgatcagctgcagcagcttgagctcaagtctgcagcgtccgagcagcagctaaggagcgggacgagc

SEQ ID NO: 7073 - DNA, 319 bp, Zea mays
  misc_feature: Incyte ID No: 700381082H1
  unsure 279, 289: a, t, c, g, or other
ggttaacatcactattcctgttcctcaaggaacaaaatcaagatttgtggtcgttgatataaagaagaaccatctgaaggttgttctgaagggccagccacctatcattgatggtgagctctataagccagttaaggttgatgattgcttctggagcatagaggatggaaaaactctttccatttgcttacaaagcacaaccaaatggagtggtggaagtctgttataaagggtggccctgaagttgatacccaaaaggtggaacctgagaacagcaantctctgattnggatcctgagactagacaactgtggagaag

SEQ ID NO: 7074 - DNA, 320 bp, Zea mays
  misc_feature: Incyte ID No: 700381084H1
aatctttgggctctcattatggatgcagggactggtttcacatcccaagtatatgaactgtcacccatattccttcataaggattggattatggagcagtgggaaaataactactacatcagtgccatagctggtgcaatgaatgggagttccttggtggtcatgtcaaaaggaactccttacactcagcagtcttacaaagttagtgaatcattcccctacaagtggatcaacaagaaatggaaagaaggttttcatgttacatcaatgacaactgcaggaagccgctggggtgtagttatgtcaaggaactctggata

SEQ ID NO: 7075 - DNA, 319 bp, Zea mays
  misc_feature: Incyte ID No: 700381086H1
ctctccccgatccagtctggatgctgcaagccaccgacgtcatgtgcgttcagctacatgaacgagacgtactggacacaaaaccccagcgtcccgacggtgaccaacgacccagactgcaaaaggtggagcaacgaccagcagacgctgtgcttccagtgcgactcgtgcaaggctggcgtcctcgcgggcatcaagaagagctggcgcaaggtggccgtcctgaacatcgtggtgctgattatccttgtgatcgtctacgtcgcgggctgcgctgcgttccgcaacgcgaagaggatcgacaacggcgaggcgatcg

SEQ ID NO: 7076 - DNA, 316 bp, Zea mays
  misc_feature: Incyte ID No: 700381087H1
cttgcaacaaaggattttatccatttaatgttctcttctatgctcttcacatcccaattgcacttgaagattgctgcactacctgtgttttgctgggcgcttgaccatgttgccagattcttaaggcgtaattttgcgcgatcctctttctataggagatacctggaagaaccttgtctttgggtagagacaaataacactacactaagcctccttagttcgaatgcggagattgccttgggttttcttctgatcatatcactgttctcgtggcgccgtagcatagttcagacattcatgtactggcaggtgttga

SEQ ID NO: 7077 - DNA, 318 bp, Zea mays
  misc_feature: Incyte ID No: 700381089H1
gcttcaaactggtggcaatctatctgttcttggcgaagtggggggttcttcgaaggacaataatataaacaatgcaaaaaacccggaggaattaaagccattgtctttgtctcagggggaaattgttttcaacattgggaaaagtgtagttgagaataaatctgattctcttgcattcagacgtcctggactacaaaaagaaggatcaaaggtcgtctatggtgttccaaaacatggaaagaagaagaagtttatggaagtaagcaaacattatgatgcaggccaatctgacaagatttctgagggcattcatctaac

SEQ ID NO: 7078 - DNA, 190 bp, Zea mays
  misc_feature: Incyte ID No: 700381090H1
aaacattgaactgattgatctcaaggtccgctacaaggacgatctaccattagttcttcatggtgtaagttgtatgtttcctggcgggaaaaagattgggattgtagggcgtactggaagcggtaaatctactcttattcaggcccttttccgcctaattgagcccactggagggaagattataattgac

SEQ ID NO: 7079 - DNA, 318 bp, Zea mays
  misc_feature: Incyte ID No: 700381091H1
cgctctctcggtggaagttggcgacgactgggcgaccgccgccgccgtacgccaggtgctcaggtctccgtcagacccttcgccaggtcttcttcggcggcgagcaccgccagggtgtgcacccaatcttcttcactgggtcctccgctgcttctagtcacgcatctaaatccggagttgccagcattcgcttgaggtgccggaccacagcacaccatcatgcaggctagcgataggttcaacataaactctcagcttgagcatcttcaagccaaatatgttggtacagggcatgctgatttgtctagatttgaatgg

SEQ ID NO: 7080 - DNA, 318 bp, Zea mays
  misc_feature: Incyte ID No: 700381092H1
  unsure 259, 279, 293, 302, 314, 317: a, t, c, g, or other
ccttattagcacaacacatgcatgtggcttgcctggagctcctcgagaagaatcttcagcatataatttgcatctgggatgcaggcaaagaagagagtattgaaggtagaactctgcactgggttgttgctcatggccatcttagtgctattgaggctcttgcaaaagaaaatatggaccaggattctatgcacaatgaagggcactcgacactcccactatgttgctgtttatgaaagagaagacgttgcagtggcanaagtcctcgtcaagcatcangtcacccttcagtncagggacangttctcaacgcnttnc

SEQ ID NO: 7081 - DNA, 195 bp, Zea mays
  misc_feature: Incyte ID No: 700381095H1
  unsure 172, 177-178, 180-181, 183: a, t, c, g, or other
gcctgatcctccaaatcaccacaggactattcctagccatgcactactcaccagacgcctcaaccgccttttcatcaatccgcccacatcactcgagacgtaaattatggctgaatcatccgctaccttcacgccaatggcgcctcaatattctttatctgcctcttcctanacatnngnngnttccctatatta

SEQ ID NO: 7082 - DNA, 324 bp, Zea mays
  misc_feature: Incyte ID No: 700381096H1
  unsure 319: a, t, c, g, or other
gcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctnttttg

SEQ ID NO: 7083 - DNA, 315 bp, Zea mays
  misc_feature: Incyte ID No: 700381101H1
  unsure 2, 8, 85, 202: a, t, c, g, or other
gncctggncagcagcagcgaacttcgaggccgctccgccacctcgccacttcgcctcttctcgctctcgccaccgggccaggganggggaccatccgatcggctccgtcatggctggagctgctgctctcaatgagggtatcctttcttccgtgtccgagaaaaatgttgctgctcacccatggcatgatttggagataggnccagaggctcctgaagtgttcaattgtgtggttgagattcctagaggcagcaaggttaagtatgagttggacaagatatctggtctgatcaggtggatcgtgtccttatcctc

SEQ ID NO: 7084 - DNA, 303 bp, Zea mays
  misc_feature: Incyte ID No: 700381102H1
  unsure 301: a, t, c, g, or other
gtgggaagagcggcctcgtggctctcaacttggatttcgatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggagggattgagatcgaggagaatgggacaaggttaagactatttcctcctatgagaagccatgacgtctgattcatgtgctccttgatgcnac

SEQ ID NO: 7085 - DNA, 304 bp, Zea mays
  misc_feature: Incyte ID No: 700381103H1
  unsure 113-139: a, t, c, g, or other
gtcgatttctcaagcttgtttctttcggggtaagcgagaggcataggccatcatcagacgagagggagaaccagcgaggactgccaagaagatgctgaagagactgctgacgnnnnnnnnnnnnnnnnnnnnnnnnnnngctgcctcctctgccataccgacgttggatcggctccatgagactctagagatgctggagaagaaggagcgtttcctccagaagaatgttccgcggaaatagagaaggcgaggattacacaaaagcgagaacagaagccgcattccatgcctaaagaagaagaaa

SEQ ID NO: 7086 - DNA, 305 bp, Zea mays
  misc_feature: Incyte ID No: 700381104H1
  unsure 2, 16, 22, 43, 61, 74, 157, 203, 273: a, t, c, g, or other
tngaagagcagcagtnaaaganatatctagtgaaaaaacaggnagcgtattgaagcttggnctagaatttcttnttggtattaaagagacaagtttatcacagaattttttttacctgctggcctattgctataccaatgatgttgagtggcatttncctttttagtttttcattaaaatatattccatatctacgactatantatcaaataaagtgattatttttacaaccctcttaacatttttggagatgacatttctgattttcagaantaacataaaatccagaagcagattccgtaagc

SEQ ID NO: 7087 - DNA, 301 bp, Zea mays
  misc_feature: Incyte ID No: 700381106H1
gggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccattggtatgggtgcgtc

SEQ ID NO: 7088 - DNA, 307 bp, Zea mays
  misc_feature: Incyte ID No: 700381107H1
  unsure 57, 69, 87, 105, 191, 238-239, 280: a, t, c, g, or other
cgaagggaagggaagcaggagcgagacaaatccccacccggctccaaaccctagccncctacccccgtncctgtaccccagatactncgctgccgtctgacccgnctcgcttcgatgtgacccggccctagggtttgagacgtgttgcggtaggggtgttctcaaggattcacgacacgagagagatgccngggaggcgtcgacggtgcgagcacacatgaaggacccggcgcaccgnncgaaggtggtgctccggcggctgccgccggcgatcgcgcanaggccgttgtggaccaggtcgattgcg

SEQ ID NO: 7089 - DNA, 300 bp, Zea mays
  misc_feature: Incyte ID No: 700381108H1
  unsure 120, 182, 217, 253, 259: a, t, c, g, or other
cttaatctcagacagctggaaggtagtattccgccctcgcccagccacccgagtaaatgagaatgatgactgactgagaccctgatggtggtggcttaggcttaatctcagacagctggnaggtagtattccgccctcacccagccacccgagtaaatgagaatgatgactgactgagaccncgatggtggtggcttaggcaagatgaacgtctganatggaggcccagggctgccacgatggctctgtagtncatcanggagggagctcttttatcttgttactactcccctcttgtgc

SEQ ID NO: 7090 - DNA, 301 bp, Zea mays
  misc_feature: Incyte ID No: 700381109H1
ctgagaatgaaaatccacctttaatgccggcaatcatgactcctggtggtgcgcttgatctcgcaactgtactactgggaaatcgtataatcttcattggccaatatattaactcccaggtggcccaacgtgtgatatcacagcttgtaacacttgctgccatcgatgaagaggctgatattctgatatatcttaactgccctggtggaagtctctattcgatcttagcgatttatgattgcatgtcctggataaagcccaaagttgggacagtgtgcttggtgttgttgctagtccaagc

SEQ ID NO: 7091 - DNA, 303 bp, Zea mays
  misc_feature: Incyte ID No: 700381110H1
  unsure 19, 34, 36, 38, 44, 63, 112-113, 115-116, 143, 165, 178, 207, 239, 245,: a, t, c, g, or other
ctctttacggactccactnatgactccctaaagncnangtcgangcccccatcgctgggtcantagtacttgccgcagtactcttaaaactaggcggctatggtataatacnncnnctactcattctcaaccccctgacaaancacatagcctaccccttacctngtactatccctangaggcataattataacaagctccatctgnctgcgacaaacagacctaaaatccgctcatgnatactnctcaatcagccactagccctcgtagtaacagccatctcatccanaccccctgaagnnt

SEQ ID NO: 7092 - DNA, 303 bp, Zea mays
  misc_feature: Incyte ID No: 700381111H1
  unsure 139: a, t, c, g, or other
gttaatttgatcgttgaggataaatttcaccgtgccagccctggtggaactggaggtgtgaaaaccattggaaactatgcctcggtactgaaagcacaaaagattgcaaaggggaaaggatattctgatgtcctttatntggatgctgttcatgacaaatatcttgaagaagtctcttcctgcaatatttttgttgtgaaagacaatgttatttctacgcctgccataaaggaacaatacttcctggtataacgaggaaaagtatcatgaagttgctcagagcaaaggtttcaggttgaggag

SEQ ID NO: 7093 - DNA, 310 bp, Zea mays
  misc_feature: Incyte ID No: 700381113H1
  unsure 2, 33, 176, 217, 258-266, 270, 276, 288, 290-291, 305-306, 308: a, t, c, g, or other
cnatgatctcagattccttgatgggcgggagangagatagctctcctccagggacttgatcttcatgtccttgaccaggcggcccagcttggtgatgggcatccactccttatcctcggccttgcctctgcaagctccgtggccttggtcccggctccggtgctgtccacggccgngaccccagccccagatgccactgctgaaacctccgtggagnttactgtggttgcccatcccagggcctctgacacccccccnnnnnnnnncccngttgancggggttaatcngnnatccggggttttcnngnaa

SEQ ID NO: 7094 - DNA, 311 bp, Zea mays
  misc_feature: Incyte ID No: 700381114H1
  unsure 189: a, t, c, g, or other
ggccttctgtcatcttcagggagtagtgcatcgtgatttgaagccagagaattttctcttcacaacaagagatgaaagcgctcctatgaagttgattgactttggtctgtacagattttattagaccagatgaaaggctcaatgatattgttggaagtgcttattatgttgctccagaggttctacacncatcatacagtcatggaagcagacatttggagtataggtgttataacatacattctgctctgtggcatcggccatctgggcaaggacagaatctgggatctccggtccgtattgagggctga

SEQ ID NO: 7095 - DNA, 310 bp, Zea mays
  misc_feature: Incyte ID No: 700381116H1
  unsure 5-6, 10, 28, 30-31, 33-34, 37-38, 42, 86, 94, 110, 144, 150, 172-173, 176,: a, t, c, g, or other
ttggnncaanctgtgagaccaaagaccncnntnntanntcangcaggcacaaacaagactgatgttgtctgtggtccccaggatcngctagagngcctggtggtgatccncatcatcttcgggatcctgtttgccatcctcttngtgctnatcttatcaaaaaggtggccannaanccaaccaataaggctccnancccaagcaggaaccccangnnatgattttnncgacgatcancctggctacaacactgctgntccagtgcaggagattntanangatgccatcggtcancnatgangatggnana

SEQ ID NO: 7096 - DNA, 304 bp, Zea mays
  misc_feature: Incyte ID No: 700381118H1
  unsure 44, 75, 83: a, t, c, g, or other
cttccttcccaggtccggtcagctcgggactcgggagcggcagncccaaccatacgtccatatccccctcccaanaaaaaaanaactcccatcaatggcgatctgaatcaaccaaggcatctggaagcttggacatggagcggatcctcaagtccgccagggagtcgggctccctgaacctctccaatcgctccctacagggagatacccaaggaggtttacaacaacttggacatggcagccaggatgagaaatggtgggagggagtggacctccaaaagctcttctggctcacaataatctt

SEQ ID NO: 7097 - DNA, 304 bp, Zea mays
  misc_feature: Incyte ID No: 700381119H1
  unsure 124: a, t, c, g, or other
ccgtcgccgcctcgggccaaaccctacgcagggagttgattgatcgattgcagccatgagtaagttgcattccgagcttctcaaggattgcatctcccagatagttcaggatgccaagaagaanaggaagttcactgagactgttgagcttcagattagtctgaagaattatgatccacaaaaggacaagcgtttcagtggctctgttaagttgcctcacatccctcgttccaaagatgaaggtgtgcatgcttggtgatgcccagcacgttgaggaggctgagaagatgggattgactacatg

SEQ ID NO: 7098 - DNA, 301 bp, Zea mays
  misc_feature: Incyte ID No: 700381120H1
  unsure 191, 258: a, t, c, g, or other
gtcgaccagcgacctggctagctagctctccagctgcgcgcgccatggccaacccaacagctaccaagcatgctttcaagcgtattttgacgagcctgcttaagcctggcggtggtgaatacggcaagttcttcagccttccggcgctaaatgatccaaggatcgataagcttccctactctatacgtgtnctcctggaatcagctatccgccattgtgataacttccaagttacagagagtgatgttgagaaaatcntgattgggagaacacatctccaaagctggctgagatacctttc

SEQ ID NO: 7099 - DNA, 294 bp, Zea mays
  misc_feature: Incyte ID No: 700381121H1
ctcagatatgttggaagtcacatcgaagactatcagaacattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttccttcgtcatcacatgctctgttctgccgtgactgttcaggtgtatggtagtaagtaatgtattaactggtgatcatagtatattcctat

SEQ ID NO: 7100 - DNA, 83 bp, Zea mays
  misc_feature: Incyte ID No: 700381122H1
tggagtggccttttatgagaggggacccgtacaaatctgtgccttatggaggggtccggcagcggccacaattgtcttgtccc

SEQ ID NO: 7101 - DNA, 241 bp, Zea mays
  misc_feature: Incyte ID No: 700381123H1
  unsure 76: a, t, c, g, or other
gcactacgacggaggcagcggtggcgccgggaacgctaacgcgctcttcggcggcgggggcttcatgccctcacantccacggtggtcccggagaacagcggcctctctaagggtcggagcgcgcagacgctgctcccgctcaccgtgaaacagaccatggacgcggcgcaaaccagcggtgacaggtctaatttcgccatccaacggcgttgaggtgtctacgattaggcttgttggacg

SEQ ID NO: 7102 - DNA, 95 bp, Zea mays
  misc_feature: Incyte ID No: 700381125H1
  unsure 2, 8, 21, 69, 76, 81-82, 84, 90-91: a, t, c, g, or other
ancctgtncttttccagagcngacagcacgggctaccggcgcagtgtgcctggcttggacttgcccttnccccatngactnngngctgtnngtag

SEQ ID NO: 7103 - DNA, 292 bp, Zea mays
  misc_feature: Incyte ID No: 700381126H1
  unsure 34: a, t, c, g, or other
agcagtcatcatctttttgtgtgcaggctgtctncatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagcctagtgtcacctttctcttgtgtctccttatggtacactccagcggttgcctttttatcattctactgaagttgggaaatcaaccccagaaatgacagatgaaag

SEQ ID NO: 7104 - DNA, 298 bp, Zea mays
  misc_feature: Incyte ID No: 700381127H1
  unsure 27, 98, 232: a, t, c, g, or other
gtatttagctgactcgccacactccanggaagcaatatgaaatgatctgctgcagtgctctgagccctaggattcatctttcttttcaccgtaggggncctgactggcattgtattagcaaactcatcactagacatcgtactacacgacacgtactacgttgtagcccacttccactatgtcctatcaataggagctgtatttgccatcataggaggcttcattcatgatntcccctattctcaggctacaccctagaccaaacctacgccaaaatccattcatatcatattcatcg

SEQ ID NO: 7105 - DNA, 303 bp, Zea mays
  misc_feature: Incyte ID No: 700381128H1
  unsure 149, 301: a, t, c, g, or other
ctgtcacagcgccgacgcttcccaattccttccaatcggcacctacgccgtcctcgtgtgcaatccccagctctcctcgcccctaccctcccaaactccagcggccccccctgaccaagctccggggacggatggacggaggagccggntttccgggcacgcagccggtctcccgctcgccggaggacgtcttccgggactaccgcgcgcgccaggccggcctgatcagggcgctcaccaccgatgtggagaattctacgtgatgtgcgacccagagaaggagaattatgtttatatggantc

SEQ ID NO: 7106 - DNA, 308 bp, Zea mays
  misc_feature: Incyte ID No: 700381129H1
  unsure 50: a, t, c, g, or other
gtcatcgtgtctcctcgatcccctctacgttcctccctcgtcgcctcatncaattcaagatccaatctttgctgctgccactacggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaaccttcgggaccagcaagccgaccaccaggacgcttcaatgtcgttaaatgaatttctgcg

SEQ ID NO: 7107 - DNA, 305 bp, Zea mays
  misc_feature: Incyte ID No: 700381130H1
aaggcatttccatgatctcagatcgctccagttttctttatgaaattaatggagaataaatatatgtccttgtttcagttgcttgcccgatgcacaaggtcgaggtttgtccatcatccaagctcgttcagctacaagaggatgctgccatttctaatggaagacgaaatatatgctcaagaaagtggcagggtcaaaattcgaaaagttgctgaggaaaggcagtttgcggcaaacaagcatgatgcctcagccaatgggcagcatgtctgctgtctcggatgactcttctcaggaaggcatag

SEQ ID NO: 7108 - DNA, 305 bp, Zea mays
  misc_feature: Incyte ID No: 700381131H1
  unsure 281: a, t, c, g, or other
atccaatcttgcatccccatctctgtctttgctcctccatggccatggccatggcccgaccttgtgctttccttctcttcttcctagttcttttctcctacgacggatccggtcctgggagcagcaggaggactaggaggagtggcgtcgcgcaggccacgcagagagtcttcctgtatccacaggctcccaaggtctcctccatcgtgagcagcaagtacaggaccgcgtaccacttccagcctcccaagaatggatcaagatccaaatggaccatgtanacaatggtatctaccaccattcta

SEQ ID NO: 7109 - DNA, 310 bp, Zea mays
  misc_feature: Incyte ID No: 700381132H1
  unsure 2, 33, 42, 57, 59, 66, 69, 75, 126, 161, 164, 167, 170, 217, 240, 250, 254,: a, t, c, g, or other
gnaagatcgagcggaaggtcggcagcaggcgcntagatgcangggtgagggcacggncngcagcgnttnacgggngacgagtaaaccctaacgctttgattgcgggcggcgtcgtctgagccagtnccgagtcgatacgctgtcatgcctgtcaatcctcntcngcnacntcctgggtcgtcgtctttggctccggcgggggccagctacttcccgntccctttccacctgcagcagcancagccgccgncgcngcaagtgaccgncgnntatngcganatcaagtatcagcatatcagcaacagctgca

SEQ ID NO: 7110 - DNA, 296 bp, Zea mays
  misc_feature: Incyte ID No: 700381136H1
  unsure 6, 37-43, 54, 60, 64, 71-72, 74-75, 87, 90, 101, 103, 108-109, 128, 130,: a, t, c, g, or other
ggctgnattccctaatgtgattgaagcagcacatcannnnnnngatcacactcncctggnctanactaaanntnnccaggcagtgtntanatccaggaatnanggcannatacttcagtccacgactnanggaggcngngatcnggntcttggccanatgggttgcaacctatttagtgccacttgacgtgagtngagganangtaagcagagaaattgataatgtgggtaacaaatggatcccaacattccagaaaactgctaaacagttttgcttgggaaaataaccaaggaga

SEQ ID NO: 7111 - DNA, 211 bp, Zea mays
  misc_feature: Incyte ID No: 700381138H1
  unsure 19, 49, 52, 54, 58, 78, 80-81, 88, 109, 111, 118-119, 124, 131, 139-140,: a, t, c, g, or other
gggaggggtgacacagtgntccctcctggcagcaattaagggtcttcangtncntatnttaggagaggccaaattgtntnntgtcatnggcgtgcacacgtgtgtgtgncngtgtgtnngtgtntaaggtntcttatanncttaaatcctaatntcanacaagtgcnanannactggcctgactatatgaaanctggtactgtgnaacata

SEQ ID NO: 7112 - DNA, 290 bp, Zea mays
  misc_feature: Incyte ID No: 700381139H1
  unsure 26, 247: a, t, c, g, or other
ggcatggcctgtcacacacaagctangatgttccctccgccactgttgcagagtcccatgagcaatgtgaaaatgtggcaggcccaaggttttcttctctggtccagagagggcgaggcaagagcaggaagcaggttctacagctctgagaatgctgagctagagcagcagcctccaggcaaatgggttaccaaagcaattgccttctgaccagactgggtgctggggctcagagagatccagtatncttgccttctgaaaccagggtctagcggacaaaacatattcca

SEQ ID NO: 7113 - DNA, 293 bp, Zea mays
  misc_feature: Incyte ID No: 700381140H1
  unsure 31, 58, 247: a, t, c, g, or other
ggagaatgataatgttagttctgtttctganagcacgggcactccttccccctatgtncacaaatcaaccttataccaccccagaccattctcagaatgtttaccaggtacctcaaccatacaatgtgccaagcaatacatattcagaagcttacccacaacaaggtacaggagcctatggatacaacaatgcatatcaacctcagcaaccagccaatatgtttgttccacctagcacacctcccancatgagcaacagccaggcccttcacatgtaccagtgcctcagcaaa

SEQ ID NO: 7114 - DNA, 255 bp, Zea mays
  misc_feature: Incyte ID No: 700381142H1
  unsure 2: a, t, c, g, or other
gnccaagtgcactagaactggacttattagcggggccaaggcccctgtaggctgcgtgtttgtgggttaaaagcagtgagcactgagcagtgttgtaacttttgcttctactgatgtttcagcgatggtgtgtgccacgggaatatgaccatgtcaacctgatgataagttgtctggcctggttcatattgacctgtgtcgtgactgttccgaaattcactcatctggtatcaatgtctgatctatgtacgttgc

SEQ ID NO: 7115 - DNA, 294 bp, Zea mays
  misc_feature: Incyte ID No: 700381143H1
  unsure 15, 100: a, t, c, g, or other
ccagatccgggaggnccgcaaggggtacaaggccggcgcgctgcgggcggggatgaggcacgcgtacgtgcgcgactgcgagtacgtggccatcttcgangccgacttccagcccgacccggactacctcaagcgcaccatcccctacctcgtccacaacccggagatcgccctcgtccaggcgcgctggagattcgtgaacgcggacgagtgcctgatgacgaggatgcaggagatgtccctggactaccattcaccgtggagcaggaatgagctcctccgtctgcgccttct

SEQ ID NO: 7116 - DNA, 297 bp, Zea mays
  misc_feature: Incyte ID No: 700381144H1
  unsure 58: a, t, c, g, or other
gggccgaaccagagccccgtcccaactccaccacctactcttctctacggcgcgagcnaaggcggcgccggccgcggcgtcggcgggaaccgggcctcgctctcctcatctctccgatcacttctgtcttgtgaaaatggcggatgaactatgctcaatgtctgtgggtcagaagttccatgggcagtccgtgctgttgagcagaatttcttcctattctgccatgaacaaccctgtattcaacaatgcctattctgcttacaatgtgccccagaggtcatatcatgggatgaatgc

SEQ ID NO: 7117 - DNA, 303 bp, Zea mays
  misc_feature: Incyte ID No: 700381147H1
  unsure 87, 166, 253-254: a, t, c, g, or other
gctggacgcgccgctgaacgagatcaacgtgcacgtgtaccagaacacgatcctgccgatgcagcgcggcgggttcgtctccaaggncgcacgggcgacgccgttcacgctcgtggtcgcgttcccgttcggggcgacgcaggccgacgcggagggcgcggtgtancgtggacgacgacgagcgcccggagatggtgctcgccgaagggcaggcgtcgtacgtgcgcttccacgcgagcgtgcgcggtaaggnngtgacggtgcggtcggaggtgctgatgggaagctacagctgcacaaggg

SEQ ID NO: 7118 - DNA, 312 bp, Zea mays
  misc_feature: Incyte ID No: 700381149H1
  unsure 18, 24, 73, 97, 109, 160, 166, 176, 186, 192, 224, 241, 270, 290: a, t, c, g, or other
cagtctccactgcatctnaaaaanaacgtaaaacccccaccacgccgtagcggagagaagagaagagaggagngcgcgatcgatgtcgggctccggngatcgtcgcggnggcgggcctccaggttcccatagtggctgggaaaccatggggaagaagtcnaagaancccgggcaanccgggggganacagtnggcaccatggagttccacaaatgtgacacctnacacagcaagaccagcntgggtggcagtggttcctcgcaccctctngaacaacttgggctcaactncaatcatggtgtgtaccagagg

SEQ ID NO: 7119 - DNA, 308 bp, Zea mays
  misc_feature: Incyte ID No: 700381151H1
  unsure 2, 17, 27-28, 39, 50, 59, 69, 84, 91, 108, 126, 135, 147, 151, 154, 164,: a, t, c, g, or other
cntggtctgctcgttcnttctgtgcannagatctgaggncccgggcgacngtgaagcantttcaatcgncggcatggcgctcgnattgcanagtggggctggaaacangaatgcttcaaagcactnattgctgcnagaatacagtgngatnaangttgagttgncgaangattgtggagatgggtgtctccaacaagancctgagtttactaagatgaacncccttggganggnncctgtnctggagactcctgatngcgctgtttttgagagtaatgctatcgcangcctnttgngcgcttganngc

SEQ ID NO: 7120 - DNA, 306 bp, Zea mays
  misc_feature: Incyte ID No: 700381156H1
  unsure 41, 64, 67-68, 211, 236, 257, 263, 268, 272, 275, 295: a, t, c, g, or other
catcctttggagggaatcgggcgaacccggtcctgggcttngaaaagctgggaggcggcgtccntgnnccgcgctgacctcttactcgcgcctgttgctgcaggaagcgtcccgtcgccgtcgggctcagtgccaggagccggcgctcctttcagaccggtgtttaacgatttggaccgccttccatgggctacgtgcaggcgatgaagcnacccggcgcccagggctcccagagnactacacggacctgctgtcantcatanagganaggncanagagatccggcctaatatgntggcagcagca

SEQ ID NO: 7121 - DNA, 78 bp, Zea mays
  misc_feature: Incyte ID No: 700381157H1
  unsure 4, 7, 16, 30-31, 35, 46, 64, 77: a, t, c, g, or other
ggantanatgccagtnttggctgaaatggnntatntaccatagttntatatctgtgtggtgttntgtaccggcacgnt

SEQ ID NO: 7122 - DNA, 310 bp, Zea mays
  misc_feature: Incyte ID No: 700381160H1
  unsure 264-265: a, t, c, g, or other
gcctcgtcagatcgaccgggaagaagggagcagaagccaaccggctcgtccgcccgttgcctgtccgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgctttgttcnncggtggagatggcaatgcatgctgattctgatgtaatcacccaat

SEQ ID NO: 7123 - DNA, 317 bp, Zea mays
  misc_feature: Incyte ID No: 700381163H1
  unsure 10: a, t, c, g, or other
acaaaaccanagacggagaagaagaaaagattatttttcaagaaagcagaaaacccatctacctgcatatgctttgggtgaaattgatgaaggtgctccaggtgctgatatcgagaaggccggaatcgtaaatcaacagaaactagagaagaaatttgggcagtcttctgtttttgtcgcatcaacacttcttgagaacggagggaccctgaagagcgcaagtccagcttctcttctgaaggaagctatacatgttatcagctgcggctacgaagacaagaccgactggggataagagatggctggatttacggatc

SEQ ID NO: 7124 - DNA, 312 bp, Zea mays
  misc_feature: Incyte ID No: 700381164H1
  unsure 2, 9, 22, 44-47, 50, 63, 144, 163, 202: a, t, c, g, or other
cncaaatgntacaaattaacanacaaaacagtcattggatgtannnngantcatggagactgncttacgctgacaaagattattgaagcaagactaaagatgtataagcattccaataataaggccatgactacgggggcaatngctgcaatgctgtctacantcctgtatcaaggcgctctttccatactatgtttacaancatcatcggtggactgatgaagaaggaaagggggctgtatacagctttgatccagtagggtcttaccagagagactcctcaaggcggaggctcagcagtgccagctacag

SEQ ID NO: 7125 - DNA, 308 bp, Zea mays
  misc_feature: Incyte ID No: 700381165H1
  unsure 11, 278: a, t, c, g, or other
cggaggacgcngccgccgcgcgccgacgggccgccataaccgactaccgcaagaagctgctcaactgcagggagctgcgagtcgcgcgtcggcaccgtgagagaaagccttaaaaatgcaaagagggattttaccaagactgaagacgacttgaaatctctgcagagcgtggggcaaataattggagaggttctccgacctcttgataatgaacgctttattgtgaaggccagcagtggtccccgatatgtggtcggttgccgaataaagtagacaangagaattgacatctggaactcgtgttgtac

SEQ ID NO: 7126 - DNA, 295 bp, Zea mays
  misc_feature: Incyte ID No: 700381166H1
  unsure 76: a, t, c, g, or other
atttctctgagggctccttccttccttgttggcgatgaggaggcacgggtggcagctaccctaccatcctctccanctggtggcgatagggtcttcctggcgctcggattcgctttctacgtcttctttgttccctttgttggtggagataggctgcagtatttgctcatgggcctctataccccactgatcacctgcgttatcctattatatatatggtgtgctggaacagatcctggtgatccaggcatttctaaatcaaaaaggccacctgaaaagcaaggaagttcaactc

SEQ ID NO: 7127 - DNA, 306 bp, Zea mays
  misc_feature: Incyte ID No: 700381168H1
  unsure 19, 63, 95, 145, 166, 182, 196, 293: a, t, c, g, or other
ggaaatagaaaccgtctgncactatcctgcccgccatcatcctagtcctcatcgccctcccancccctacgcatcctttacataacagacgaggncaacgatccctcccttaccatcaaatcaattggccaccaatggtactgancctacgagtacaccgactacngcggtctaatctctantcctacatacttcncccattattcctagaaccaggcgacctgcgactccttgacgttgacaatcgagtagtactcccgattgaagcccccattcgtataatattacatcanaagacgtctgcac

SEQ ID NO: 7128 - DNA, 313 bp, Zea mays
  misc_feature: Incyte ID No: 700381169H1
  unsure 84, 105, 113, 125: a, t, c, g, or other
cctcctcatactttaccgcaaagcgcggcaccacgaattgcacctacccatttcgctaatctccctccacgagccgaccaaatncgaatcgaatccgcgcgcagncaccggcngcaggatttgcnggcgatggcgagcctcaccctgccgccggcgccccccaacccacggcaggacgccatcgacctccaaaaggcttcaaaagggtttggctgtgacagtacaacagtgataaacatacttactcatcgcgattcagtgcagcgtggactcattcaacaggaatacagggctatgtatcatgaggaactct

SEQ ID NO: 7129 - DNA, 304 bp, Zea mays
  misc_feature: Incyte ID No: 700381171H1
  unsure 33, 81: a, t, c, g, or other
gacccgccgcgccgcagtctagaagcttctgcnggccgtctgcggcccgcccatccgcaacccatggctgtcgtcgaagangacgctgcggcgtctgcagatcccgccgccgcgtccgatcccgccgctggctccagcgaaaacgagatcacagtagaagaggcttctttcgtgcattctgaacctccccaggatggcagcgccccacccgtggtttcctctgacatggaggcccttcacgacaaggttaagaagcaaatcatcaaagaaggccatggcaggaaaccgctgaattcgcgacgtg

SEQ ID NO: 7130 - DNA, 305 bp, Zea mays
  misc_feature: Incyte ID No: 700381172H1
  unsure 77: a, t, c, g, or other
gtgaaacagtcagagttataactgcttctattgaaaaggatatatgggcttctggaagtgctaacgaagagtatctncaaagcactcaatgctttgctgagtaacttccctcgtctgagggtcactgaacctgccacattgtgcattcctcatcttgtaacatcccttaaaactggttctgaggcaactcaagaggcagcactagattcactatatctctcaggcaagcttggtcagcttgcccagctgaagtattaaagcacaatcagtcgctgcatcggaggctatcctctacttcatacttg

SEQ ID NO: 7131 - DNA, 305 bp, Zea mays
  misc_feature: Incyte ID No: 700381174H1
  unsure 3, 37: a, t, c, g, or other
ganattgcaccttgcaatgaacccagaaaatctacanacagaaggattgaaaaggacccctgctattgaggaatttgaggtgaagcttaaagttgctaatgagagattgacaaacattgatgaaaacatcaacaagctaagtgggaccgagagagaagaaatgggaaatttctgtggttctgattggacaaaagagcaggacatggcattgcgcaaagctacttcagtgcccgaccatccccacatttctggaagagagtttcaaaatggtgccaggagatctgctgaagactgcttcaacagaa

SEQ ID NO: 7132 - DNA, 303 bp, Zea mays
  misc_feature: Incyte ID No: 700381176H1
ctagtaatgggaactgtcttgaagctcatgcatttcttcaactcctggcaacctttggtatttctgctgaatataatgaagatgacctgtgcaaattgcttccatatgtcagtcgtcgtcgtcagacacctgaactttgtcgattgcttgggttgtcacagaaaatgccaggtgtcattgaagttctggtgaaaagtggaagaactattgatgcaataatttagctacgtgtttgagctactgaacagtttgaaccagtgcaacgcttaaagcatatctgagggagttaagaaacgtcacatg

SEQ ID NO: 7133 - DNA, 227 bp, Zea mays
  misc_feature: Incyte ID No: 700381181H1
  unsure 7, 12, 19, 21, 47, 106, 108, 110: a, t, c, g, or other
gttcggntcgcngcgacgngngcggttcgccgcccccgaccgtaccnagaacgtccattgaaccttatcatttagaggaaggtgaacaggaagaacaagcagcagnangncagcagcacaaaggccgtgtcctagaaacggttggttttaacgcgttttatggccacattaacaccggggccgccacattcatatccggtcatgaaaaggataataatcattgactg

SEQ ID NO: 7134 - DNA, 293 bp, Zea mays
  misc_feature: Incyte ID No: 700381183H1
  unsure 11, 24, 44, 88: a, t, c, g, or other
gcagttttgcntgcagcggcgganaggtagatatggcgtcggangccaaggacgtgggcatcctcgccatggacatctacttcccgcncaactgcgtgctccaggaagagttggaaacacatgatggcgtgagcaaagggaagtataccattgggcttgggcaggaaagtatggcattttgcactgaagttgaggatgttatttcgatgagctgacagcggtgaagtccctcctgaaaaatataacatgacccaaagtgcatggacgtttggaattggcatgaaaccgtaata

SEQ ID NO: 7135 - DNA, 302 bp, Zea mays
  misc_feature: Incyte ID No: 700381184H1
gcaagcacgcactctcagtcaacatgacagattctggaggttaaccagcaggagcagagataacttacaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttg

SEQ ID NO: 7136 - DNA, 294 bp, Zea mays
  misc_feature: Incyte ID No: 700381186H1
  unsure 2, 176: a, t, c, g, or other
cnaatttgaacaagtgggcagtggaggtttctgaatctgggaccttttcagctcctcttgggtctggtggtcccggtggccttccagttccttacctagttattgccaacaaagtggatattgctccaagagatggtagaagagtgagcagtggtaatctgttgatgttgctcgtncaatgggttgaaaaacaaggtctgcttccatccagtgaagtgctccacttgcagataactttccggcaatctggtttgctcacggctgccaaagaggcaagatatgataaagaagctc

SEQ ID NO: 7137 - DNA, 301 bp, Zea mays
  misc_feature: Incyte ID No: 700381188H1
  unsure 45, 68, 95, 99, 105-107, 117, 119, 128, 130, 153, 176, 210, 237-238, 262,: a, t, c, g, or other
cattcgtacgcgtgcttgttgtctctgtcagccatcaacttctcnagtgagctgcgagcctacaaggntgtgggcagtgccagcctcaacctcgncctncaccannntctcaccgancntcggactgntntcccgcaggcacgggtgcacggnacgcggtttccactcgcttcgtncgcgttcggatcgccctcagagtaacagtctagnagagcaagcatgtcgtcgtcggaggannacgaccccacggtgaggtgaccgngcgcggatgcaaggacaagnatgancnncgnggcgacaa

SEQ ID NO: 7138 - DNA, 68 bp, Zea mays
  misc_feature: Incyte ID No: 700381189H1
  unsure 11, 29, 36, 45, 47, 51, 58, 64: a, t, c, g, or other
ggccttcccgncggaggtagtctatctgngtgagangctgtggantnttcnactcaancttggncttc

SEQ ID NO: 7139 - DNA, 300 bp, Zea mays
  misc_feature: Incyte ID No: 700381190H1
  unsure 101: a, t, c, g, or other
ggtcaagccaggttccatcaagccccaccagaaggtggaggcccaggtttacatcctcagcaaggaggaaggtggccgccacaagccctttgtgtcccacnctcatgcctgtcatgttctccctgacttgggacatggcctgttcggattatcctgcccccagagaaggagcttgccatgcccggggaggacctgaagttcaacctaatcttgcggcagccaatgatcttagagaaaggccagcgtttcaccctgcgagatggcaaccggactatggcaccggtctagtcaccaacacgc

SEQ ID NO: 7140 - DNA, 295 bp, Zea mays
  misc_feature: Incyte ID No: 700381191H1
taaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagttcctctcccaagtgccacacaggggaggtgatagcatgctttcgtgtaaattatgtatgcaaaatttttttaatctcgcctaatactttttatttgttttat

SEQ ID NO: 7141 - DNA, 300 bp, Zea mays
  misc_feature: Incyte ID No: 700381192H1
gtaacctgcgcgattctattcttgcgacggaagcaaaatctgcacgagagacagacgacgagatggccgatgcggaggacgccgccgccgcgcgccgacgggccgccataaccgactaccgcaagaagctgctcaactgcagggagctcgagtcgcgcgtcggcaccgtgagagaaagccttaaaaatgcaaagagggattttaccaagactgaagacgattgaaatctctgcagagcgtggggcaaatattggagaggttctccgacctcttgatatgaagcttgtgaaggccagcatg

SEQ ID NO: 7142 - DNA, 298 bp, Zea mays
  misc_feature: Incyte ID No: 700381194H1
  unsure 9, 36, 262: a, t, c, g, or other
gaaaggtangagatgtgaggatgatttctgataganattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggcttatgtgggctcatacacttcaacataatgaagattngctcgtgggatctttgagcctttgggagattgaaag

SEQ ID NO: 7143 - DNA, 304 bp, Zea mays
  misc_feature: Incyte ID No: 700381195H1
cactagcaaccgtccccacaatcctccgacgatgcctgccgcaccgacgctgttgcccccctgcgacgcggaggagccgctgctggcggagtcctccgaccgcttctccatgttcccgatccgtttcccgcagatctgggagttctacaagaaggcggtggcctccttctggacggcggaggaggttgacctctctgccgacgcccggcactgggacgaggcgctgtcccccgacgagcggcattcatctcccacgtgctcgccttcttcgctgcctccgacggcatcgtgctcgagaactcgc

SEQ ID NO: 7144 - DNA, 309 bp, Zea mays
  misc_feature: Incyte ID No: 700381196H1
  unsure 34, 97, 100, 105-106, 112-114, 133, 196, 209, 227, 308: a, t, c, g, or other
catgcctatcatatagtaaaacccagcccatganccctaacaggggccctctcagccctcctaatgacctccggcctagccatgtgatttcacttcnacncaacnnaggagnnnatactaggcctactaaccnacacactaaccatataccaatgatggcgcgatgtaacacgagaaagcacataccaaggccacnacacaccactggntccaaaaaggcttcggantacgggataatcctatttattacctcagaagtttttttcttcgcggatttttctgagccttttaccactccagctagcccnc

SEQ ID NO: 7145 - DNA, 162 bp, Zea mays
  misc_feature: Incyte ID No: 700381201H1
ggagttccatccatcgccgctcactcccacgatcagcgtcgtcgcttatccgcaaatatctctcttcctctttgcagtcggcaccatgggttccgacttcaaatcgatccccttgatcgaaaggccatggtattgatgagtcactgatgagggaagtcagga

SEQ ID NO: 7146 - DNA, 298 bp, Zea mays
  misc_feature: Incyte ID No: 700381202H1
  unsure 255, 273, 284, 286, 295: a, t, c, g, or other
ctcaggttcagattctatctgaagcgtggggatatcgaagtgaagaccaatttctgcactgtctcccgctgcaccatgtgcatgggcttttcaatgctctatttgcgcccctttattcaggatcagtggttgagtttataccaaaattcagtgtaagcgggatatggcagagatggcgagaatcatatcccaacgatgcgagtaaaagtacagaggccattacagtatttactggagttccaaccatgtatacangtctgctgcaagggtatnatagtatggancnggatcaaangtg

SEQ ID NO: 7147 - DNA, 295 bp, Zea mays
  misc_feature: Incyte ID No: 700381203H1
  unsure 42, 140, 290: a, t, c, g, or other
agggtttggtgaaaaattccggccgccttcgcgtcgcgaggngggggacgagacgaagccagagcgccccaaacccaaaccccagaacaccgacatagggttacgccatcgccatgggatctgttgcctccgcagcagcnccaccttctcctcactcagcgctaccccaggagggcgcgccgccctatggccccgggctcgccgggatcctcccgcagacgtcagtgggagaggagaagaatgaggagaaggtggactacctcaacctcctctgccccgtgcccttcgangagat

SEQ ID NO: 7148 - DNA, 297 bp, Zea mays
  misc_feature: Incyte ID No: 700381207H1
  unsure 2-3, 25, 40-41, 43-44, 52, 62, 69, 71, 77, 81, 93, 120, 192, 197, 200, 205,: a, t, c, g, or other
gnnggaaaagcttcaggggacattnttctccacagaagannanncctctaancctctggtanagaactnancgagcncttncagcctctcaanccagcgcatggtctttgcttctttcanccaagcaggatcctcgtataccacaggtagaaatgctgagtctaggtgtaggaatcttggttggctgtctcngcctnctnctggntgttnatttcattgctanaaagantcggaagaagaggctggaaaatcgaaagngtgtggtctacanctcagcacaagccacgactgangcat

SEQ ID NO: 7149 - DNA, 292 bp, Zea mays
  misc_feature: Incyte ID No: 700381208H1
  unsure 55, 121, 196, 277, 284-285, 287: a, t, c, g, or other
ctcaggttcaccgctgatgttcgttccgtgctgagccgaaaccttcaccaacatncggctctggtgacagctgctccccctccacctgagttggggtgggggggaaagggagggcgagccnttgggatgccgtctgatgccctgtccaatgtgaggactgcctgggcagggtctgcccctcccacccctctctgcnctgggagccctacactccacttggagtctggatggacacatgggcaaggggctctgaagcagcctaatctaaatcccggtnacacccnnanggaaa

SEQ ID NO: 7150 - DNA, 164 bp, Zea mays
  misc_feature: Incyte ID No: 700381211H1
  unsure 8, 17, 27, 39, 48, 53, 77, 97, 108: a, t, c, g, or other
agctcgcncggtacgtngccgcccttngccgacccggcnctgcctcgnccgcnacggaacgtcgccttcctcacctncctattcccttcggcatgtncgtagccggcnactcggcgactggcctcgacctccgccgcttccttgcctttggcatggttcaccag

SEQ ID NO: 7151 - DNA, 293 bp, Zea mays
  misc_feature: Incyte ID No: 700381212H1
  unsure 65, 67-68, 112, 222, 265, 286, 289, 292: a, t, c, g, or other
ctacactcgcaattcatccgcagtcacaagctcggctgctgctcccgctaacggttgaggcgtcncnnactgcacacaggaagggaagggaagggagagctgcacacagctntgctctggctcttggctcccctgtccagctgtcctgtccgtccatcatggaggaaacgcccagcccgcagctctagccgccgtcaatctcgtctcgtatcggagtcgaangaagtaagaggcgggatggcatgaagcgacttaccaagaatgngggttgggaaccccgggaatnatnagng

SEQ ID NO: 7152 - DNA, 78 bp, Zea mays
  misc_feature: Incyte ID No: 700381213H1
ctttattctcttttcgttttgtgtatttgtggtagaaatttcattcactccgatgacttcacttattatctatacata

SEQ ID NO: 7153 - DNA, 297 bp, Zea mays
  misc_feature: Incyte ID No: 700381214H1
  unsure 19, 40, 68, 117, 211, 291: a, t, c, g, or other
gtctgagaaacccattctnaaattgtatattagaagcaanctgttgcacattttggtttgtttgccgnaggaggatttgggaaagtggagttggtaccattgagaaggagtctagtnccaaactggctaatctagcatgtgaacaaacaggaatccaaataacttgttttcaaagcagagctgtctcaatgtagcaagtataggtagtgcnaaccttacttcaggaagtgtcctcaaattggggtcccacttaggagatggagaaaaagagaaggaaaagtgccagtcgcngtggct

SEQ ID NO: 7154 - DNA, 303 bp, Zea mays
  misc_feature: Incyte ID No: 700381215H1
  unsure 58, 60, 67, 72, 80-82, 221, 229, 248, 250, 265, 267: a, t, c, g, or other
ctcgagcggtctacgacaaggtggtgaacattcccaacagcatgaccaatcttggatnancttctgnctatntccctccnnntggcgaaacgggactgcaggggcatatggaacttcaccaaccctggcgctgtaagccacaacgagattctagagatgtacaagaaatacatcaatcctgatttcaagtggaccaacttcacactcgaagagcaggccanggtgatantcgcgcctaaaggaaaaangngatttggacgttccnanttgaaggccgagttccctcagctgctgtccatcaag

SEQ ID NO: 7155 - DNA, 174 bp, Zea mays
  misc_feature: Incyte ID No: 700381216H1
ggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagca

SEQ ID NO: 7156 - DNA, 291 bp, Zea mays
  misc_feature: Incyte ID No: 700381217H1
  unsure 243, 286: a, t, c, g, or other
gacccgcagaccgcaccctgtcggcgagctcgctcccgttcccgtccgctgctctccgctcgacgccgccgtcttccgcgcagtagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcncgaccccaagctcgttaaggaagggcagtggtatcagggcgangaact

SEQ ID NO: 7157 - DNA, 292 bp, Zea mays
  misc_feature: Incyte ID No: 700381218H1
gtttgtcaccaccttgataaaaacattccagaagatgtagcatttgccgagtctagaattcgagctgaaacaattgctgctgaggacatattgcatgacatgggagccataagtattatatcatctgattcacaggccatggggcgcgttggagaggtgataacccgaacatggcaaactgcaaacaagatgaaggtacaaagaggtagtttacctggatctggtgacgctaatgccgccccggacagtgacaacctccgtataagaagatacatagcaaaatacacaataa

SEQ ID NO: 7158 - DNA, 291 bp, Zea mays
  misc_feature: Incyte ID No: 700381219H1
  unsure 68, 78, 99, 225, 280, 288: a, t, c, g, or other
catagctcctcccgcctcaccacgcctcgggcgtccctcccattcccagcgctgtccatgagcaccancaacatggcncatcggacgacatgagttctntgctgacctccctagcggaagaaagcaaattccttgcagttatgcaataggctttaggaaaaaaagactgcaaccaacggaaatcaataggagttgaagagattaaactgactttgttttggctgnttttgtaggtctgtatgtatttagcaatctcatctcacctaactgagaggggttncattatantcc

SEQ ID NO: 7159 - DNA, 292 bp, Zea mays
  misc_feature: Incyte ID No: 700381220H1
  unsure 27, 267: a, t, c, g, or other
ccctaacagcacaaaggaaggagaganaaatggcaaccgcagaactgggtttcaaaaagcaattaactaaggaggagaagtttgaaaagaggaagcagagacttgctacaatcggagaggatcttttggcgattgctgctgatcaaccatttcgcttccctgccacatttacatttgtggtcagagcattctcagttctagatggtactgggaaaggccttcatcctaggtttcatattacagagattgctaagccctgagtacttnttgcattactagcatctgaatactt

SEQ ID NO: 7160 - DNA, 289 bp, Zea mays
  misc_feature: Incyte ID No: 700381221H1
  unsure 45: a, t, c, g, or other
caaggacgtacgtgatcgcttccaaaatgtcgtccagcatgctancgagatggcagcagcagtggagctgttcaatgatgcacacagtcgttttcagagtgctcttcagaatgtcaacacctcagcagtaattgaacagttcaaggatgctcttgatcattttcaaagtattacgcataatggcaagatggtagcggctgtggagtacggtactgaaatgcaagagaagtcaatgtgtgaagagcctcagaggaaggccaaagtaatagcaattgctgaagtactgaag

SEQ ID NO: 7161 - DNA, 288 bp, Zea mays
  misc_feature: Incyte ID No: 700381222H1
  unsure 79: a, t, c, g, or other
aggcattgtcagcgctcacccgtgacaaaactatggttgctacaagtgactatggtgacttccacaaaatgattaagcnttatatcatgacattcatgttgggtacttctggccagaaacaatttagggacacaagaaacatgatggttgacaacatgttgaacactttccatacattgttgatggatgatccaaattctcctctgaacttccgggaagttttcaagaatgaattatttcgcttatccctggttcaggctttaggcgaggatgtgagttcaatctatg

SEQ ID NO: 7162 - DNA, 289 bp, Zea mays
  misc_feature: Incyte ID No: 700381223H1
  unsure 33, 35-37, 50, 63, 65, 208, 222-223, 231-236, 267, 269, 271, 288: a, t, c, g, or other
aagtctcaacctcttgcagaggtgcaagattcngnnngaggaaaagtgancacatcctctgtngnatctgctgccattaataatgcaaagtcatccctttttgggttccatcttctcccatcatcagtcaagtttggagtgcttaaggaaggacatacctatgccacagttgtaaagctcaagaatgttggagtggacttctgcaggnttaaagtaaagcannccccagcnnnnnncaggactgaaagtgacttacaaacctggacntntngcagctggtatgcagant

SEQ ID NO: 7163 - DNA, 286 bp, Zea mays
  misc_feature: Incyte ID No: 700381224H1
tttatgcaaagaggcgtatatatgccggtgaggaaatcacatataattacaaatttccattggaggcaaaaaagataccgtgccattgtggttctcggaggtgtcgtggatcaatgaactaagaaggccatcttttgaggttgctgcaacacttaagattcttggctgtgtgcaactcatcaatcaggatttacatcaatatcaaaatatggagtgcacgaacatgctggacagcaagaacaaactgccgcattatacttatttaagctatattggtcagactatt

SEQ ID NO: 7164 - DNA, 289 bp, Zea mays
  misc_feature: Incyte ID No: 700381226H1
  unsure 25, 29, 141, 216, 220-221, 224-225, 228, 231-232, 238, 246, 249, 261, 270,: a, t, c, g, or other
ccataccccactccccccgcagganccgnacgcggcggcggcaaaggcaaaggcaaaggcaagatgttcgggcgcgcgccgaagaagagcgacaacaccaagtactatgagatcctcggggtgcccaagtcggcgtcccangacgacctcaagaaggcctaccgcaaggccgctatcaagaaccaccccgacaaggcggtgaacccgagaaattcnaggnnctnnganaannctatgnagtttttntgnatcccagaaacntgagatttntgtcanatggtgaagatgc

SEQ ID NO: 7165 - DNA, 288 bp, Zea mays
  misc_feature: Incyte ID No: 700381227H1
  unsure 28, 232, 268, 281, 284, 287: a, t, c, g, or other
cccggtcgtcgttgtcgcggcgtgagcnagcgagaggggaaaacccaaaaccctagcacccccgccccgttcgccgacggccgccggagtagagagatggcggtggacgaggtgaactcggtctacgtcggcggccttccctacgaggccaacgaggagatgcttcgcgacgccttcgggtactacggcaccatcgtctccgtcaaggtgattaatgatcatgctgtcaaangcaagtgttatggtttgttatttcatcaccccagancttgttgacaagnaantgng

SEQ ID NO: 7166 - DNA, 295 bp, Zea mays
  misc_feature: Incyte ID No: 700381230H1
  unsure 25, 31, 224: a, t, c, g, or other
atctcaatcagctgaactgtacaangatttncttcgacttctgacaggatgcagcaccagttgcttcactttgtattatttacattttctactggaaacaactgctggatactgtcagaagtcgaagcaaatctcaatcagctgaactgtacaaagattaaaaaaagagcacaacctagtctaagcatggtacattactacatctacagattatgtaactgttngtagaataagaatagagcaatgtttccatttggtttgttattttcccctttatattctattactgtagtta

SEQ ID NO: 7167 - DNA, 298 bp, Zea mays
  misc_feature: Incyte ID No: 700381231H1
  unsure 279, 283: a, t, c, g, or other
ctagcccatctgctctctcagcgaggacgaaggcacaaacccctcacctccctcaaaccctagccctcgctctcccgcttgttcccgtcaccgccatcatgggctcagatgcggacatggaggactacgggttcgagtactctgacgaagagccggaggagcaggatgtcgacattgagaaccagtattacaactccaaaggtttggtcgagacagacccagagggtgcacttgctggttttgatcaagtggtcagtatggagcctgaaaaggctgatngggntttaaagctcttaaa

SEQ ID NO: 7168 - DNA, 298 bp, Zea mays
  misc_feature: Incyte ID No: 700381232H1
ctcaaccatgggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgctt

SEQ ID NO: 7169 - DNA, 287 bp, Zea mays
  misc_feature: Incyte ID No: 700381233H1
aggaaagcactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactatggcggccgtggccgtggaaggggccgtggggagcgtggtggttttagaggcggatacggagg

SEQ ID NO: 7170 - DNA, 285 bp, Zea mays
  misc_feature: Incyte ID No: 700381235H1
  unsure 178: a, t, c, g, or other
accgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccngcgccggggacgacgacaaggactacaaggagcccccgccggcgccgctgttcgagcccggggagtcaagtcctggtccttctaccgcgcgggcatcgcgagttctt

SEQ ID NO: 7171 - DNA, 285 bp, Zea mays
  misc_feature: Incyte ID No: 700381236H1
gccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtga

SEQ ID NO: 7172 - DNA, 281 bp, Zea mays
  misc_feature: Incyte ID No: 700381237H1
  unsure 40: a, t, c, g, or other
tttgatgcagacagtgagcaaatcaaacaaaactggctangaatcactactgagggtatatagggaaaccgatctaagccaggagaaagttcgtgtgttaggttctttggcatcatcccctgaccatgatgttgtccgtgaagtattgaatttcatattgtcacctgaggtgaggaatcaggacgcaatatttttgctaagaggggtgagttcaggggcacacgaggtagcatggcaatggctgaaggaaaactgggattacatattgggagcctactctg

SEQ ID NO: 7173 - DNA, 282 bp, Zea mays
  misc_feature: Incyte ID No: 700381241H1
  unsure 4, 21, 247: a, t, c, g, or other
gcancgcggaggccgcacgangcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgacnaagatctatgggggacgtcagagaaacggcgtcat

SEQ ID NO: 7174 - DNA, 283 bp, Zea mays
  misc_feature: Incyte ID No: 700381243H1
  unsure 207, 278: a, t, c, g, or other
gaaatcgatctagccaaggtgcggcgggcgcggcttattcacgaattttctgtgttctttggaaagccgccatggacgagtggattcgccaagccgaggtgtgggtgcgccaatccgagagctggatccgccagcagcccccggagcagatctatgtcgcggccacggtggtcgccgtcacaatcctgctgcttatcgtagcatctnatctgaaatcctctaaaacaagcaacatagtgctatccgggctcagtggcagtggcaaaaccatatttctnccact

SEQ ID NO: 7175 - DNA, 282 bp, Zea mays
  misc_feature: Incyte ID No: 700381244H1
  unsure 244: a, t, c, g, or other
ggtgacgccgcaattgcagctgaccaggcaggcgctcatgtgatcagccatgcgttccctcacacctatgggcagccccttgcacatttcctcaggaagacggctgttgtccttgatgctaaggtcatatctgaacacccggtggtcagggttggcattgtcttctgtggcaggcaatccccaggaggccacaatgttgtttggggactctatgaggctatcaaggcccacaaccaaaacagcnaactcattggtttcctcggtggatcagatggtttgcta

SEQ ID NO: 7176 - DNA, 300 bp, Zea mays
  misc_feature: Incyte ID No: 700381245H1
  unsure 6, 112, 163, 178, 188, 195, 213, 225, 231, 240, 245, 256-257, 259, 264,: a, t, c, g, or other
acaaanactacaggggggagacacatctctccccacctcgcttcgcacctctccagccgccgcctcctcctttcgccggcgtcgacgatgggtgactatggccacggcgggnggcagatgcgtggcaacccggacttcccgccccaggggccagggccagcgncctaacgtccagcangctcaagctncattggngcatattccacccggacnggggcttaagtntaatcntgtttaagnttttngaaactgcttnnancgttngtgntnaaaanccccgtttnaanagcgtnaatttnt

SEQ ID NO: 7177 - DNA, 292 bp, Zea mays
  misc_feature: Incyte ID No: 700381247H1
  unsure 21, 49: a, t, c, g, or other
ctcaagaacgtcgccaacggngccaacgggagcggcacctacatcagcngcgccgccgcgctgcccagcaagtgcggcgtcgccctgccgtacaagatcagcaccaacgttaactgcaacacgattaattaagtgaggcgtcctgtgcgcgtcccgggcgaggaatgcatgcatggcgctggcggagagtaataaaataatgctactggtattttaagctagatcgaggtgtgcctgtctctagtcattattatggtgtttaggaatcgtcgtctacacagttcgtaacggt

SEQ ID NO: 7178 - DNA, 330 bp, Zea mays
  misc_feature: Incyte ID No: 700381249H1
  unsure 265: a, t, c, g, or other
aaatgatttcttagtttctgctgctgtagctgagtttaaagggcctgttgtatttggtgttgttcgtctggcccaagtaaacatggagttggctagagttgaagccacatttagtggtctatcacctggtaaacatggatggtcaataaatcagtttggggatttgacaagaggtgcagaaagcactggcaatgtctataatccaccagatcattatctgataagccacttggtgacctgggaacactagaagctggagagaacngggaagcccatttctcaggaccgaaggagaaattgagagtggttgacttgatcggccgctctatt

SEQ ID NO: 7179 - DNA, 321 bp, Zea mays
  misc_feature: Incyte ID No: 700381252H1
  unsure 30-31, 33-34, 36, 286, 300, 310: a, t, c, g, or other
ggcaggagcggcgatccattccacacaacnntnnantggttgccccagcccgccgcaggagttgccagatctgctccggtcacaggagctccgactccgagccctctccaatggcggttaaggtctacgtcgtgtactattccatgtatggacatgttggcaaactagctgaagagatccagaaaggtgcctcgtctgttgaaggtgttgaagctaaaacatggcaggtccctgaaaccctccctgaggaagtgcttggaaagatgggcgcacccctaaagctgangtgccagtcatcangccgcaaganctcgcagaggc

SEQ ID NO: 7180 - DNA, 324 bp, Zea mays
  misc_feature: Incyte ID No: 700381253H1
  unsure 84, 112: a, t, c, g, or other
ccatcatcttcctcgcagcgccggcgctccatctcccgctcccttccttactcgcgctcggcacacaggcggcggcgctacggncctcgggctctcagggacggcgtcaggngcttaccctcgcgccctcgcctccggtcctccgcacaccggccggtgaccctgcgacaacattgcatctgaactgcattggatcctaagagatgatggatgagtcttttcttgataggatggtttcccaacttcggtcaacatgcaagtactacatggatatcccaaggacttagggcgatcagaattataccattcacatctgagcgtcag

SEQ ID NO: 7181 - DNA, 324 bp, Zea mays
  misc_feature: Incyte ID No: 700381254H1
  unsure 36: a, t, c, g, or other
atgaaatactggaaaagcagaatgatttaatggagnatgcagttgatgatttcaagcttcctactcaattggttcaaagatatgttaaagtttcatgtggttcgaggcttgcagttcttcttatgattctgaaatctctatttgaaagacaagtctctcagaaggtcgttgttttcttttcaacctgcgactctgtagattttcaccacacagcactcagccagcttgagtggagctctggcccacagcgtgatatggataagaagcaaaaatttcttagctgtaaagtgttccgtttgcatggtaacatggagcaggatgatc

SEQ ID NO: 7182 - DNA, 320 bp, Zea mays
  misc_feature: Incyte ID No: 700381263H1
  unsure 25: a, t, c, g, or other
ctttacataacagacgaggtcaacnatccctcccttaccatcaaatcaattggccaccaatggtactgaacctacgacgtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgg

SEQ ID NO: 7183 - DNA, 320 bp, Zea mays
  misc_feature: Incyte ID No: 700381264H1
  unsure 35, 59, 182: a, t, c, g, or other
ccaactgaggttttcttggactacagattaagcgngctcgaaggtcgtatgtgcaaganatgactgatgagggatgctagtgaaattgatgaacttgttacgggcgtgctggcgaccgtcatcgaaccggcatgcccgaacaggctcagatgttaccggtaggcaggatggacttctatggnacaaggacgccgggcaacatgtcaatggggagttctccatggctgttgttcaggcaaataacttacttgaggaccagtgtcagatcgagtcgggcccactgagttttctagattctggaccatatggcactttcgttg

SEQ ID NO: 7184 - DNA, 324 bp, Zea mays
  misc_feature: Incyte ID No: 700381265H1
  unsure 25, 304, 313: a, t, c, g, or other
cagcaggagccaaaatggagaaagngttctctgaaaaaagatttgtgagtgtgacttttgtctaaaggagtaaaacccaatacaatttatttaagacctgcaagtttcttgagaaaattgcatcagtagaacattgccagcttggactgaaaaggacagagagagtacaaaataaaaggaagctgtagccagaagcaggctgataaaagaactcagctgcaaataagtggtaacttacatgaaaaaggaacaatgattaagagagtagagcttagacccacagagaattagtccctggtcttgnatcctaagnaaaatccacca

SEQ ID NO: 7185 - DNA, 319 bp, Zea mays
  misc_feature: Incyte ID No: 700381266H1
  unsure 44, 160, 283: a, t, c, g, or other
ctaccagcggttcatcgtccgcatcatattcttggtcccggtancgctctccgcccgccgctcacacccacaacaaaccctcgtggccaagggcgccctcgcgccagatctgtcgcctgccttcgctgtagcttttccgtatcggatgagctcgaggggnacggcccggtctgggttagtttcctggagaggttcccatgaatgttaggttgcgactgcgatggaattgaagtacaagtactcggtggaaagctttgctggtgcatgtgattctgactagaangcgaatatagagccacaaccgtgcgtttgatgcgtg

SEQ ID NO: 7186 - DNA, 314 bp, Zea mays
  misc_feature: Incyte ID No: 700381271H1
  unsure 52, 54, 137, 151: a, t, c, g, or other
acgaatcttccgaatctctcggtggcgatggcgctctccgaccgctcccgcnantcgctcctcccgagcttcctctacgcctcctcggcgcgctctttcgctgccacaggagccgccgcgcgcctccctgtctcctnccccagcgcctgcnacggctggagcaggaggcggcgtgccgttctcgatccaggcgcccaaggagaagatcgagatgtactcgccggccttctatgccgcctgcatgccggaggaatcgccagctgcgggctcacccacatggccgtcacgcctctcgacctcgtcaagtgcaatat

SEQ ID NO: 7187 - DNA, 267 bp, Zea mays
  misc_feature: Incyte ID No: 700381272H1
  unsure 181: a, t, c, g, or other
gctagtattattgttattgctgatttgctcccctctgcctttgcgatgtaaatatttgtgtacccagccccagccccagccccagccccagcttgtagtgagcagtaacaagcagtagcggtaccttcggtattaaccggcagctagctatttcgcggcattttaatccctgtaagcgtantctgtggcgtgagatagatgacaaacactgggtatatgtatgtctgatctttctcactgaatgtaccataagagagtttgtagagt

SEQ ID NO: 7188 - DNA, 303 bp, Zea mays
  misc_feature: Incyte ID No: 700381278H1
ccgagctcagcagggggaggcgctgcgcttcgcttcacgccagatccaacctcaccggccaccagcttgcccccatggccgctcgcttcctcctcgtcgttgccgtcgccctcctcctccgccctggggatgcgtccgtgcacgagtaccgcgggctcagcttcgccaacaagggcaacgacttcatcctccacgccggcagcgagggcctctacgcggcctcccacgccaacaccaccgccgaggacgccgccgcagtggccgaagccttcatccggtttgacaagattacttttaggcgat

SEQ ID NO: 7189 - DNA, 310 bp, Zea mays
  misc_feature: Incyte ID No: 700381279H1
  unsure 44: a, t, c, g, or other
agatatacaatgtgcgtggggaatcaggcatttgtttgagagtnaaggtgcgatatctagttatactcactgtgaactggatccttcctttcttctgggattaagctgtggtatcattccttttgcaaaccacaattttgctcggagggtattgtaccaatctgaaaaacactcgcaacaagctattgggtactcaacgacaaatccacacatcagagttgatactctttctcatcaactatattatcctcagaggcctcttttcaaaacagttatagccgactgtcttggcagatcagattatgcttct

SEQ ID NO: 7190 - DNA, 274 bp, Zea mays
  misc_feature: Incyte ID No: 700381281H1
  unsure 272: a, t, c, g, or other
tcttcctcgagatgggaggcaagtgcccgcaccgcaaggtaaagaagcgccgcctatcccacaagacggctcgccgcggcaagttcctcctgaaggccgacgatgccgtctatgacgagctcgtcaagctggccgaccagggcaaggacgctgaaaccaaggagctccccgtcgatgaggaccttccaggcctgggacagttctactgcctccactgcgatcgtatttgcaagtgaaagcgtgaaggatgatcactaccgtcaaagcgcacnag

SEQ ID NO: 7191 - DNA, 312 bp, Zea mays
  misc_feature: Incyte ID No: 700381282H1
ccctcattatcaatccaagggttcaaagtggtggcatcagagtacaagattccctggccactcttctgcccccgtggaaagggcagcttctgtttcatcaggttggggtcctcttgtcgtcggcagagccgcaaagccttgaagcggcttaaggttagcttgactgccttatggatcgaaaacattgaggctatcatgactcactgtcagtcccagggagccaaggctaaggatctgctagttgcagttcaagtgaaggaacagagtcatacatgcaaatccaagggcctatttggcatggctgtgggtgct

SEQ ID NO: 7192 - DNA, 312 bp, Zea mays
  misc_feature: Incyte ID No: 700381283H1
  unsure 213, 241, 273-274, 281, 294, 311: a, t, c, g, or other
ccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagtccgcgccctcatcgccgagaagagctgcgcacccctcatgctccgcctcgcgtggcactccgcngggacgttcgacgtgtcttcgaggaccngcggtccctttcggtaacaatgaagtgcccgnngaatggntaacggcgcaaangcggggctgaaaatcgng

SEQ ID NO: 7193 - DNA, 303 bp, Zea mays
  misc_feature: Incyte ID No: 700381289H1
ccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcg

SEQ ID NO: 7194 - DNA, 307 bp, Zea mays
  misc_feature: Incyte ID No: 700381291H1
ctagttctagatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccggggg

SEQ ID NO: 7195 - DNA, 260 bp, Zea mays
  misc_feature: Incyte ID No: 700381292H1
  unsure 23: a, t, c, g, or other
ggggcagggagatggagagagcncgcccccgtgaggagcacccacacctcgacggctggcatgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccggcatatccaaggccgagag

SEQ ID NO: 7196 - DNA, 302 bp, Zea mays
  misc_feature: Incyte ID No: 700381294H1
  unsure 172, 238-239: a, t, c, g, or other
aggagaaccactgaggcttggtcactgagtggagggaagtgtggcacctgagtgtctgtcttgggagctgcaggctctcagcaggtagtagtgggtggttagcaggtggtggtgccaggatggagagccaagcctagctctccagtgcctgtgctctctgctagtaccccanaccacctcctacaggccaaagtggaacagtagtgggcctttgctcctcgattccctagcctccagnnccagcctttcctaatccctcaatgtactattcctattagtcaatgtgtggcagagagatgttc

SEQ ID NO: 7197 - DNA, 308 bp, Zea mays
  misc_feature: Incyte ID No: 700381296H1
gaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaa

SEQ ID NO: 7198 - DNA, 290 bp, Zea mays
  misc_feature: Incyte ID No: 700381301H1
  unsure 32, 70, 118, 168, 179-180, 212, 219, 249, 260, 271, 274, 287: a, t, c, g, or other
ggaaggcggggggaggccggccaaggcaccancacaccaccacccgacgaattcaagcatgaggccgcanagcgcagagcagggctgccgccgctgccgctgaggagcggctacagantgctatacctattacacagcggcaacaagcacgcacgccaccgctcccgntgttgcttcanntggtgaaacagcttgctcctaagattgttgtngctattnaccacggcagttaccggggtgacctcccgntttcgcagcanttcatgaattnttncatcctggaggtncct

SEQ ID NO: 7199 - DNA, 304 bp, Zea mays
  misc_feature: Incyte ID No: 700381303H1
  unsure 37, 159, 228, 295: a, t, c, g, or other
cgtaaagcatttgctgagatgattttcaagcatggcnttgttcattgtgatccccatgctgccaatatgatggtccgaccaatgccacaagacagcagaaaactttttggatggaaaaggccacagctggttcttcttgaccacggcctctacaaagancttgattataatactaggataagctacgcttctctttggaaggcacttgtttttgctgatgccaaagcnattaaggagaacagtgccaaactgggtgctggggaggatcttcatgcactctttgctggtggtctcnctatgagac

SEQ ID NO: 7200 - DNA, 74 bp, Zea mays
  misc_feature: Incyte ID No: 700381304H1
  unsure 3, 6, 11-12, 36, 59-60, 71: a, t, c, g, or other
tgngtngcatnncatcttttttcaggtggaaatgantcttcaggcattggaatatgagnnagaacatggcnaag

SEQ ID NO: 7201 - DNA, 293 bp, Zea mays
  misc_feature: Incyte ID No: 700381306H1
  unsure 140, 271: a, t, c, g, or other
tcttctgctcgctggtgtcccctctctctcacccatggcttcggcggcggcggcaactcaggtggggacttacttcctgcggaactactacaacctgctgcaacaaacccccgatgtcgtccaccagttctacagcgaanccagcaccatggtccgcgtcgacgacctcaccggcaacaatactgcaacaaggagctgtcgttcagccattgccaagccgagagcagaagcagaagagaaactgagaagaacccagttagatcagactgangaactagttgcggtggacgctt

SEQ ID NO: 7202 - DNA, 287 bp, Zea mays
  misc_feature: Incyte ID No: 700381308H1
cgtttccaagaggagaatgtttctctcccttgcccagtcgcctgcctgcgccgtcgtctccttcccatggaggtcctcgtcccaactgcatcccacgggtcccctcccgctgcaccctcgcatgccacgcagcggtgcccaaagtgcccctccccatcgcctcgccggcctccctcggggacgaccctagcaagtgggaccccgccgagtgcgacgctctcctccgcggcggggagcaggtcgcctccgtgctgcaggagatggtcacgctgatggaggacatggag

SEQ ID NO: 7203 - DNA, 283 bp, Zea mays
  misc_feature: Incyte ID No: 700381309H1
  unsure 93, 229, 231: a, t, c, g, or other
ggctcccatctcagagctctcagcggtggcggccggcgaccggcgagctcctccggcatcggatcccctggagtggagcgttgaaccacgctncgggcctgcattcaccacctccgtgctttccttcgtcttctccgcctcatctggttgctctggtcagtgatggccggtgacattacatgcggatccttgctgcaaaaattgcagtttatatgggatgaagttgganancgtgaggaggaccgtgacaaggtcctttatcagctggatcaggaatgccttg

SEQ ID NO: 7204 - DNA, 89 bp, Zea mays
  misc_feature: Incyte ID No: 700381310H1
  unsure 43, 72, 85: a, t, c, g, or other
caagaccggaggaggcccactgcctgcatgtaacttcagatantccacccgagagttccgcaccaactcacntgcacacctcacnttgc

SEQ ID NO: 7205 - DNA, 290 bp, Zea mays
  misc_feature: Incyte ID No: 700381314H1
  unsure 2, 23, 58, 263, 269, 285: a, t, c, g, or other
tngatgctgagcactcatcagantctcaaagcgttgcacctgctgaggttcgaaaggngcaaccatcagaacatcaaaaggatgtggatatggagcagctattggaacctcaaaatcaggatcatccttggaatccactagatcctgttagtgatacagctgccaaggattcatcagagcctaaaagtgacatagctacagaaaaacctgcagaatctcaaaacaatgcagaacagtcagttgagcagcaatcagaaccgcanagcganaaatcaactgagaggncagac

SEQ ID NO: 7206 - DNA, 295 bp, Zea mays
  misc_feature: Incyte ID No: 700381315H1
cggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcgttttgtgtgttcgcctctctcaccctgtaagttttgtgagaagatgatctagtaaactgtacttggcctgtttgactgtagccgcagtagcat

SEQ ID NO: 7207 - DNA, 297 bp, Zea mays
  misc_feature: Incyte ID No: 700381318H1
  unsure 20, 32, 83, 92, 101-102, 106, 151, 205, 235, 244, 288: a, t, c, g, or other
cagaaggacaagcgtttcantggctctgttanacttgccccatatccctcgtcccaagatgaaggtgtgcatgcttggtgatncccagcatnttgaggacnncctncagatgggacttgactacatggatgttgaggctctcaagaaaatnaacaagaacaagaagcttgttaagaggcttgccaagaagtaccatgctttcttngcatcagaggccatcatcaagcagattccncgtctcttngtcctggtctcaacaaggcagcaagttccgacctggttactcancagaatcct

SEQ ID NO: 7208 - DNA, 240 bp, Zea mays
  misc_feature: Incyte ID No: 700381319H1
  unsure 115, 236, 238: a, t, c, g, or other
atcaaggccgaagtaaagcattagatagagtaaggtggatgtcgtggctagtaggtgcatggtggtttctgccacttcactcactcactcactctgttgtctgtttgttcctgtncctctctgggttctcttgctctgtaacctggacctggtacgagtcagcagccagcagcaaactcgcgttttgcctgtaaaatctaaaatctgatatgagatgcagatgcccccgcgaaaananaa

SEQ ID NO: 7209 - DNA, 293 bp, Zea mays
  misc_feature: Incyte ID No: 700381321H1
  unsure 23-24, 41, 81, 88, 215, 222, 226, 240, 255, 275, 288: a, t, c, g, or other
ttcgttctggagatgcagcagannccattacttagatgganctaagatgccatacatgacatcaaacagttccttaaacanaacttcncagttcaccactgagattcacttccttggcagagtacattcctaaatacgtcgagttgttttgtgatctatcacagaaaggtggagcaagacttttcttacctactggagctagtgacattgttatncctgtanttgntgatgagccaacangtgttatttcgtacngcattgttccacccatgtantgcttccagtgtntgatg

SEQ ID NO: 7210 - DNA, 280 bp, Zea mays
  misc_feature: Incyte ID No: 700381325H1
gtcgccgggagtctcccgatccttcttccaccacctcaccggtggtgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatgggccagcatatatccgagttttcctgaa

SEQ ID NO: 7211 - DNA, 280 bp, Zea mays
  misc_feature: Incyte ID No: 700381326H1
  unsure 12, 34, 39, 43, 50, 53, 64, 73, 83, 96, 144, 147, 151, 167, 179, 190, 194,: a, t, c, g, or other
ggccagcagganacaggacccccgaagctgaggnccttngganggagcanaanccggagtggcngggcacgcngccgccttcnccatcacggaggntccagactgtccacgcgggggtggagtgagactgactgcaagccccanccncctngagactggagctggcntctgcatacganagacttggttnaacnggnttggtccgtgtctgcnnccncgacnagaccacactttnggacttggganctggggctgaagttgctctgtacccatgaantcc

SEQ ID NO: 7212 - DNA, 283 bp, Zea mays
  misc_feature: Incyte ID No: 700381328H1
  unsure 2, 26, 169: a, t, c, g, or other
cngccggccgccgccacaccaaagcnaccatggccttttctgccgccctcgcctgggccgccacgcaacttcctccgcgggagcctccctcctgcccgcttcgccgctgccgtctcgcctctcacatacagcagcagccgccaactctgcagtacccccatcgccaacnattcctccgccgcaggaccgtgggacgaggccgagacggagatcctccgcgacgtcgagcccatcgtgaatatcgtcaaggacatcatccactcccgcagtataaaaatggtga

SEQ ID NO: 7213 - DNA, 284 bp, Zea mays
  misc_feature: Incyte ID No: 700381329H1
gggaggaggcgctgggcggtgccggggcgttggataggagaggtcaagattcaagaacgacgacacgccgaagtagcagagggatccgttggcctcccgtacccagcccccttctaccccttcgtcgacggctgggattgcggcggcgcccttgtcttcgccggcgacgagcatcgccagggacttccgattggggggggcgattgcggagatgggctgatcagaactgcgacaaggtccggttttctcctccaaattgtggtctctggaggtggatttgcttt

SEQ ID NO: 7214 - DNA, 285 bp, Zea mays
  misc_feature: Incyte ID No: 700381330H1
  unsure 50: a, t, c, g, or other
ggattcagacagtggacattgacacagaacttccagtgtattgtccattngaagtgacagttgctgaaacggattattatgatgagaccaactattgtgaggtgacaccttgtcttctgccagaacgctcagtgcttaaaagcattcgagtttgtgggcctagatattggcctcaggtgataaaacttgcacctgaagacaagccatggtggagatctggagacaagacaaatccattcaatgggggagtactctacataaagcgaaaagttggatcttgctcct

SEQ ID NO: 7215 - DNA, 290 bp, Zea mays
  misc_feature: Incyte ID No: 700381331H1
  unsure 67, 241: a, t, c, g, or other
cgtaaacccttctctcttcttcccgcggcctgctcgttctatctgtccagcagacttgaggttccgngcggccggaaaccagcggcaaccgtcggcatggcgctcgtattgcaatctggggctggaaacaaaaatgccttcaaggcacttattgctgcagaatacagtggggtcaaggttgagttgaccaaggattttgagatgggtgtctcgaacaagacccctgagtttctaaagatgnacccccttgggaaggttcctgttctggagactcctgatggccctgtttt

SEQ ID NO: 7216 - DNA, 283 bp, Zea mays
  misc_feature: Incyte ID No: 700381335H1
  unsure 34, 109, 187, 203, 206, 211, 263, 266, 276, 282: a, t, c, g, or other
caaaaggtcacctttgcagttggaggcatttganaaatgtgctaaagaatgtggtctagaccctaaaaagaccctttccttggatgttgctactagatggaactctacntatatcatgattagagatgccatttactataagaatgcttttgatcgtctggctaaaaaagataagggcaaatatggncacatcaatccttcangcnctgantggttgaatgccacaaatattagcaagtggttgaaaaaaatctatgtgcacntgnttttcggtanttcaanc

SEQ ID NO: 7217 - DNA, 282 bp, Zea mays
  misc_feature: Incyte ID No: 700381337H1
  unsure 100, 225, 250, 253, 273: a, t, c, g, or other
tttaccgcggcaaggaccacgtggacctggcccgcgacttcacctacatcgacgatattgtcaagggctgcctcgcctccctggaaacggccggcaacancaccggcaccggcggcaagaagcgcgggccggcgccctacaggatcttcaacctcggcaacacctctcccgttacggtgcccaacctggtgtccatctggagaagcacctccgcgtcaaggccangaagaacgtggtcgagatgcccggnaangcgacgtgcccttcacgcangccaacatt

SEQ ID NO: 7218 - DNA, 274 bp, Zea mays
  misc_feature: Incyte ID No: 700381340H1
  unsure 36, 221: a, t, c, g, or other
cgctgctcaccgcccagctccaggtacgcgcgagtnattagagaaataagggtcggcttggttgcccgaggcctacccagcgcctgcgatggaggagaaggctatggcaaatggagcagcgactgctgatgttgctgctcctgataataaggataacaccaaggaagaggctagcgagagcaaggaaccagcagccaatcaggatgccgatgaccagaacnaaggcttggaaaatggcgccgagggccagtcaggtggagatgtcatatggcaa

SEQ ID NO: 7219 - DNA, 275 bp, Zea mays
  misc_feature: Incyte ID No: 700381343H1
  unsure 17: a, t, c, g, or other
tgcaaggcttgtatgtngcaaagcttgtgcgatcattctgtaggtcatccagtgattctgaagaggaagacatttttgagtacgttgcctccacacttgtcaatatatctaaggttgaagctggaaggagaatattgttggagcctaagagaggtcttctgaagcagattattcgacaatttgattcaacaaatcaacttagaaagaaaggggttgctggtacaattcgtaactgttgctttgaggctgatactcagcttctgagtttgctttct

SEQ ID NO: 7220 - DNA, 277 bp, Zea mays
  misc_feature: Incyte ID No: 700381344H1
  unsure 42, 176: a, t, c, g, or other
ctgctttccagtgctatggagaatatgttagtggttcaatcnctgatgagcaaagaaagaacgtcctccgcaattcatgtccaggagcaggtgcctgtggtggtatgtacacagcaaacactatggcatctgctatcgaaactttgggcatgagtcttccatacagttcttcgacncctgctgaggacccactaaaactagaagagtgccgtcttgctgggaagtatctttagagttgctaaagatggatttgaagcctaaggacattatcactgag

SEQ ID NO: 7221 - DNA, 277 bp, Zea mays
  misc_feature: Incyte ID No: 700381345H1
cacaaattgtgggcctttctgtacccgtaggattgagattgctgaggttgctcttagctaccattgaggctcagtaccggcagaagctctcctacctttttggacggatttgtatcgaaaatcttggggtgtgaagttgtattctgcatcatctgctgaagaagtctgcagatgcttagtgtgctggaaagtgcaataaagcgagattacttatcatctaattttgaaacgacaactgagttgcttaattcaaacacacaagatgctacccagattc

SEQ ID NO: 7222 - DNA, 280 bp, Zea mays
  misc_feature: Incyte ID No: 700381346H1
gtggcgcgatccgcgggagagcagcaatgacggcggaggggacggcgtgcaacggcgccggcgaggcgtggaaggcggaattcgcgccggagaaggtggtggccgtgtccctggaggagaagccggtcggggagcgcgagggcgaggacgtcggcgggccgttcttgatcgtgaacggcggcgattccgacgggcactccgagcctggctcagatctgggcaaggcgcccgacgaggaccctgcatccgaggaggacgacgtgcccacttaatgcagtcc

SEQ ID NO: 7223 - DNA, 289 bp, Zea mays
  misc_feature: Incyte ID No: 700381347H1
  unsure 196: a, t, c, g, or other
atccgcttcttgggtcgacccttcgacagcgcccccctggcagacccgggcaacaacattgtgcttcgtggtgctgcagtggccgctggagacacgtcgacggggagccccccaagaccctctatcagctccaccgatgccatgagagcgcaagaaggtgaccccctatggctgcgaataggggccatggttgctngctggcactcgagcaaagccgacgccgactatgaccatgtccccatgagtcaacagactggtgactacgccgcttgggagcacttcgccagaa

SEQ ID NO: 7224 - DNA, 289 bp, Zea mays
  misc_feature: Incyte ID No: 700381348H1
  unsure 8, 261, 285: a, t, c, g, or other
cacaagangtgcttttagagacaaatgccttgaactagcacgtgaccaagggcgagtatgatgagacggggccgtccattgtgcacaagaagtgcttttagagacaaatgccttgaactagcacggttggtgcaccatttgctgctgttcatgtcgcagttgtgctcgtacctgaacgttgcggccttgcgggtgctgatgcagcgatgcttgtgtctacacttactccagccacagttcatactgacgggttgtaagtgntgatgcatctagctactcggttangatg

SEQ ID NO: 7225 - DNA, 302 bp, Zea mays
  misc_feature: Incyte ID No: 700381355H1
  unsure 94, 117, 192, 291, 295, 301: a, t, c, g, or other
gtctggctttcagaattaacatacaaggttgccacacctagttctgcctcagctttatgtcttttattccagtattccaccaaagtttgttttncctgcattccagttctcaagtcntaagataaagattgtacttgacagtttagtatatccataaaactatttgaggtggttaaggttcttgggttcatnttccttaatactttgctgaatattgtagattgtaggcaatgaaaaagtctactaaattaggaaaaccttgaataattaggtatcctaggtaagagcccncaancatcang

SEQ ID NO: 7226 - DNA, 305 bp, Zea mays
  misc_feature: Incyte ID No: 700381357H1
  unsure 8-9, 23, 25, 30-31, 33, 49, 52, 58, 67, 83, 85, 91, 115-116, 124, 133, 155,: a, t, c, g, or other
cgccaagnncatcgagtccatcngncgcannanggtcttcctcaaaggnggnctcgcnactcccgtnggcggtggtgtgtccncnctcaangtgcagctccggaaggagctcgannctctacgncgcgctcgncaattgtttcaacctccctggncntgcctaccangcacgacaacgtngacattcgtcgttcatttcggganaacagtgagggcgagtactcgggagctcgancatgaggtcgttcctggcgtcgtngatantctcnaggtgatancnnnnttctnctctgaaagnattgcnc

SEQ ID NO: 7227 - DNA, 300 bp, Zea mays
  misc_feature: Incyte ID No: 700381360H1
gagacggagatgtcaagattacctgccatagtgaacgtgttgaaagagacatcattttatcacacaagtaagcttgcagatcgctgatatgacattgttggtaaagatattgaagtcttggcctccacaaatgatgtttccagtcattgattttctgagaatgttcgtgttgcatcctgatggagcttctttacttctcaagaccatcgaaactggaaatgatatacttttggaaacctttcgtaaagctgttgcgtcgcctgtacagccagcaaatttgcttacagtcctcaaagctgt

SEQ ID NO: 7228 - DNA, 302 bp, Zea mays
  misc_feature: Incyte ID No: 700381361H1
  unsure 128: a, t, c, g, or other
tacagctacatctcttggagctatatcctatcttggaaactatacaaaagtatctttggcctcgcctttgtaaactcgatcagcagacactgtatgagctgcattatcagatgattacatttggaaangccttttgtaccaaaagacagccaaattgcaatgcatgcccaatgaggagtgagtgcaagcattttgcaagtgcatttgcaagtgcaaggcttgcacttcctgctccccaggaggaaagcttagtgaagttgagcaatccatttgctttccagaatagcagcatgcatgctatg

SEQ ID NO: 7229 - DNA, 302 bp, Zea mays
  misc_feature: Incyte ID No: 700381362H1
ccactcgccactctcacgtctcgcccatcccgccactgctgctctccagagtccaggcgacccaggctgcgcggttcgcttcggtgttgttagtcccgaccgccgccggccatggcatccaacggcatcgccccaagagatgtatgtgttgttggcgttgcacgcacccctttgggtggtttccttggtgccttgtcttccttgcccgcaacaaagcttggttctatagcaattgaagctgctctgaaaagagcaaatgtggatccggccctcgtgcaggaggtctttttcggaaacgtctt

SEQ ID NO: 7230 - DNA, 297 bp, Zea mays
  misc_feature: Incyte ID No: 700381366H1
  unsure 64: a, t, c, g, or other
agaaaagctgggaggtaaactttcctctgaagataaggagaccatggaaaaagctgtagaaganaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattga

SEQ ID NO: 7231 - DNA, 295 bp, Zea mays
  misc_feature: Incyte ID No: 700381368H1
ggacgcacaccagcacggcagcacctgccctcctcgccgtcgctgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgt

SEQ ID NO: 7232 - DNA, 295 bp, Zea mays
  misc_feature: Incyte ID No: 700381369H1
gattttagccgccgccgctgctcatctcacatccctcgagaagacgcctgctcctcgccgatcgatacgatggccgtcttctccgacctccacaccgccgacggcctcaagtccctcgaggctcacctccgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgta

SEQ ID NO: 7233 - DNA, 296 bp, Zea mays
  misc_feature: Incyte ID No: 700381371H1
  unsure 29, 82: a, t, c, g, or other
ccaccagcctcgtcgttaggacgtaaggnaagacacccaggggcgagccagtgagtacagagagtagccttacgtagcgaantcagagcaagcgagggtacggtcaaggggggtgatggcgctgtctcgacgtatggcggctcccgtcctcgtcctcatgctcctcctcgtcgccacagagctggggacgaccaaggtggcggaggcgaggcactgcctgttcgcagagccaccggttcaagggcctgtgcatgagcagcaacaactgcgccaacgtgtgccagaccgagaacttc

SEQ ID NO: 7234 - DNA, 125 bp, Zea mays
  misc_feature: Incyte ID No: 700381372H1
  unsure 6, 25-26, 35, 42, 78, 83, 106, 111, 123: a, t, c, g, or other
gctgcnttatgggacccaggcactnnaagctgcangcctgcntttccggtgcttccgctatgaggaggccacaggganccaanaggcacctgatcccagctccganagctntgtgcgccagtngc

SEQ ID NO: 7235 - DNA, 294 bp, Zea mays
  misc_feature: Incyte ID No: 700381374H1
  unsure 27, 44, 52, 252-253: a, t, c, g, or other
gggtccaggattacgaaggaaaccaanaacgcaagaacacgtcnaagaagangggaggaaagatttgggtgtagattggtagatatattacacaggttttgttttggtgtaggttattagcaaataaatagctggagaagaagcctggcaaaaaaaaggtgaaatttgtggagaacatgtttgggatccaaaccagggatgtggcagaagatttcaactcctggaggaggacattaaggaacacacccaccnnctcaatgcccatgaacaaccacaacattatgtacaacacag

SEQ ID NO: 7236 - DNA, 293 bp, Zea mays
  misc_feature: Incyte ID No: 700381376H1
  unsure 172, 177, 212, 220, 273: a, t, c, g, or other
cgcaggggcttctgctgagggggcaggcggacttgaggaaaccgcagataagtttttttctctttgaaagatagagattaatacaactacttaaaaaatatagtcaataggttactaagatattgcttagcgttaagtttttaacgtaattttaatagcttaagattttaanagaanatatgaagacttagaagagtagcatgaggaagganaagataanaggtttctaaaacatgacggaggttgagatgaagcttcttcatggagtaaaanatgtatttaaaagaaaattg

SEQ ID NO: 7237 - DNA, 293 bp, Zea mays
  misc_feature: Incyte ID No: 700381377H1
attgctatgacaatgttggttcaatgatttctcaggttcctctgtaccaatctttcaaccatggttagtagattctgcttactggaaagttgggaaccgttctctgttgaacttgctatattgtgccgtcctatgttaagtggagttactttagattcgagccatttcgattacagaaaattccaaaaaattcatgtaatgtcgaacgtattagtttgtataatggggagtcctaattcgttgaaactaatatcgtgaactagtctggaactgtaattcgtgtctaatatcta

SEQ ID NO: 7238 - DNA, 298 bp, Zea mays
  misc_feature: Incyte ID No: 700381380H1
gtccgcgagaagagcctccacgacggctgggacgccgacctcgagtgccatgtcatcaacgaggacctggtgtgcgacgagcttgaggacatgatggaagaaggtggcatactagtagattaccacggatgtgatttctttccagaacgttggtttgacctcgtagttgtgctccagactgacaactcaattctgcatgatcgcctgacgggtagaggttacatgggttccaaactcgccaacaacatagagtgcgaaatcttccaagtgctcctcgaggaggcgagggagagctaca

SEQ ID NO: 7239 - DNA, 276 bp, Zea mays
  misc_feature: Incyte ID No: 700381381H1
  unsure 9, 105, 120, 122-145: a, t, c, g, or other
gcggacggncaagccaagcagaaaaatacgagtatcgcacgcgcaaggcgattccgtcaccattctccacccaatagggagctagagctacgagagggggaaacngggggacgggaatangnnnnnnnnnnnnnnnnnnnnnnnnggaacttcggtgggtctggcgatcctgtaccagtgtgggctggtcgcttcgccgcgtggtcttcagttctaccgcagtctctcaactacagcgcagagtgtgtgggctgaattcgatttctgtgttgaatt

SEQ ID NO: 7240 - DNA, 244 bp, Zea mays
  misc_feature: Incyte ID No: 700381383H1
  unsure 18: a, t, c, g, or other
ctgagcaacgccgcgganagatgcaggtcacgctggctcctcactccttcaccgccttcgatctggcgctggctgagcccaagcttgtggcggagatatgatgtgtgtgctgttagcgatcttgatcgataaaaaggctttgtactggtgtaccatgatacaggataacgtactacgtactgttgcttcatgaaataaaaaccacatcaggtttttgcttggtgttggttggtttcctttctcc

SEQ ID NO: 7241 - DNA, 289 bp, Zea mays
  misc_feature: Incyte ID No: 700381384H1
  unsure 21, 67, 182-183: a, t, c, g, or other
actagttctagatcgcggganaacttcatgctgcagatgccaaacttgcagaggcaaaccgcaagangtctcaagctgaccgtgatttagaagaggcggaagctcgtcaacgtagactggagaaggagaaactgtattttgagacagagcggaaggcccgagaaaagcaacttaaggagcanngaggaatcactgcaggaatgggagaaaaagctgaaggaaagtcagaatagacttaatgagttgcagagatctataaatgagcgagaggagagagcaaataagaatg

SEQ ID NO: 7242 - DNA, 289 bp, Zea mays
  misc_feature: Incyte ID No: 700381388H1
ggcttgccttacagacaattgcctttcgttcctcctggaatcatcagaagtcaaagacgatgctgcttacagagcaccagaaaacatgaaatccaacagaatgctaacgcccaaatcagacatatatgcttttggcgtcctcctccttgagctccttagcggaaagccaccgcttgagcactcagtcttggtcgcaagcaatcttcaaacctatgtccagtctgcgagagaggatgaaggagtggacagtgaccgcatcacaatgatcgtggacatagccacgagctgc

SEQ ID NO: 7243 - DNA, 286 bp, Zea mays
  misc_feature: Incyte ID No: 700381390H1
  unsure 38-39, 41, 50, 57, 144, 148, 150, 157, 230, 247, 252: a, t, c, g, or other
gaaaatgtgaagataatcaattttgataatatccttcnntntcccttacngcttctnggacattatcaaaattgattatcttcacattttctccaatgcgaagataatcaattttgataatgtccaagaagcagtaagggagangaangntattttncccaaaagtggaattgtcacggtgattaaagatgctttaattcctagtggaacaatcatataaagtcagccancccatgtatataaggtngggtngcatcatatggtgatcgccaatgcgcatcaagtt

SEQ ID NO: 7244 - DNA, 288 bp, Zea mays
  misc_feature: Incyte ID No: 700381392H1
  unsure 153, 159, 163, 167, 172, 174-177, 180-182, 192, 223, 228: a, t, c, g, or other
cacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaccacctacctccgcncctacnagancggngattncnnnnatnnnaaggtgaacngcgccgtccacaaggggatgccgcacaagtnctacnacggccgcaccggtcgcgtctggaacgtcaccaagcgcgccatcgggtcgaggtcaacaa

SEQ ID NO: 7245 - DNA, 288 bp, Zea mays
  misc_feature: Incyte ID No: 700381393H1
  unsure 16, 196-197, 250-251, 254, 256-257, 259-260, 268-269, 274-275, 278,: a, t, c, g, or other
tgggatgttctctcanataaggaggctgtcgacatagtagcatcagccccatctcgtgcgacggcagccagggcccttgttgactgtggctgtcaggtcatggaggttgaagttcccaacatccaagagcgatgactgtgctgttgtctgcttattcttgggtcacgagaagtcggccgactcggttcaagggagnnaacccaatgtggagacagcagaacccaccgtggaggtttccagttccacacannatncnngnnccaccagnngacgnntgnannnnggntg

SEQ ID NO: 7246 - DNA, 291 bp, Zea mays
  misc_feature: Incyte ID No: 700381396H1
  unsure 5, 19, 27, 39, 50-51, 63-65, 93, 158, 161, 163, 179, 191, 216-217, 262,: a, t, c, g, or other
gatanataagacagatggntagatagntaagatagatcnacaggaaatgnnatcagtatgtcnnngagacatctgcactcccattttcattgnagcattgttcacaatagccaagatatggaatcagccgaagtgtccatcaacagatacatgaatanagncnatatggtatatatatnatatacatatanacagcggcatatattcagctttacnnagaaggattcctgttatttgtgacgacataggtgaatctggaggntgtnaagttaagtgtnataagccaggcac

SEQ ID NO: 7247 - DNA, 287 bp, Zea mays
  misc_feature: Incyte ID No: 700381406H1
  unsure 28-32, 36, 49-50, 58, 78, 129, 132, 166, 171, 177-180, 184, 186, 190, 193,: a, t, c, g, or other
ctcgaatattgagctccttttatttcannnnntacnctttactgacaannatacagcnctggacatacccctattgtnccattcgatgcgctgtatttttgtcagtaaagtgtagccttgaaatgaacnatnggggtatgtccagcgctcatgcaatttttatcanggcgnatcttnnnngccngncacnganantgttnttnttncgggcgnggtaaaggggttttntattccggttncngggagnttccctcttgtggtttggggtttggtgggggtntcagnac

SEQ ID NO: 7248 - DNA, 298 bp, Zea mays
  misc_feature: Incyte ID No: 700381408H1
  unsure 47, 99, 135, 138, 169, 194: a, t, c, g, or other
gtggcttccacccacagccttcgcacttccctccttcctcgcaaatngccgtcgccgtccccaacgctcccggccgcctcttccttctccaatccaccncgttcccgaaccctagcagctcggcatccgccgctngancccaatccttccgcgtaccacccctccgccnctcgctattccgacgcatggctggncgctcgctgacggtgatcgcaggcgcctccggggctccgaacgagatctcagcgcctccgcagtctccgtggaggccctggactccatcgcctccgattctgat

SEQ ID NO: 7249 - DNA, 302 bp, Zea mays
  misc_feature: Incyte ID No: 700381410H1
  unsure 86, 164, 260: a, t, c, g, or other
accacttgccacttgggatacgctgacctctgagcagcctcgatccggctcgttcaaacttgaccgaacggcagccattagctggnggcgcctcctccttgccggagccgcctcgccggcgggtggcgacgctgccgccgctgtcacagggctgctcgcaccangcgctgcacgtacgctacccagtacccacactccgctccagtacacccaccgagacatctaacccaagcttgatctcatctcgtgcactcctctcnccttcccctcctctcctagggttagcaagcttgatcccgtgc

SEQ ID NO: 7250 - DNA, 299 bp, Zea mays
  misc_feature: Incyte ID No: 700381411H1
  unsure 6, 26, 31, 34, 41, 44, 51, 59-62, 64, 66, 69-70, 78, 83, 85, 88, 90, 101,: a, t, c, g, or other
ctgtcnctctcgaatcctaactccanaaacnctngatctcntcncatggcngccgcagnnnntnanganngcagcagnggtgnancgntntacagagctcngcgagcgcctctcggccgacaatgaacannacannnnnntagggactacgaggcgattattgcagcggtgaagggacagagtgccaaggcgaagagctcgcagcgcagttatccccaggttcttccggagcttcnctgcactcggcacgcgcgcnatgtcagccatgttcgatctcgtcgatatggaggagtcgcgat

SEQ ID NO: 7251 - DNA, 303 bp, Zea mays
  misc_feature: Incyte ID No: 700381414H1
  unsure 7: a, t, c, g, or other
gccagtnactgcctttggagatgaccttaaagctaggttggcaactgagacattatttactatagctaacagatatggggattatatacgcaccggctggaggaatgtattggattgcatcctgaggctgcataaacttgggcttctccctgcccgtgttgctagtgatgcagctgatgattccgaacttcctgctgaagcagtccaacgaaaggctgctcctagttcagttcccccatctcatattccagtgatgggcacacctcgcaaatcatccggactcatgggaagatttagtcagct

SEQ ID NO: 7252 - DNA, 312 bp, Zea mays
  misc_feature: Incyte ID No: 700381415H1
  unsure 5, 33, 53, 57, 83, 87-88, 102, 107, 113, 117, 120, 159, 180, 224-225, 284: a, t, c, g, or other
cagangaactaatgttagtataagtaacatganaacattctcctccgcataancctnccgtgcagattaaagacactgaattncgcnnttaacagcccaatntctanaatcanccancangtcattattaccctcactgtccaacccaacacaggcatnctcataaggaaaggttaaaanaagtaaaaggaactcggcaaatcttaccccgcctgtttaccaannacatcacctctagcatcaccagtattagaggcaccgcctgcccagtgacacatgtttancggccgcggtaccctaaccgtgcaaagg

SEQ ID NO: 7253 - DNA, 65 bp, Zea mays
  misc_feature: Incyte ID No: 700381420H1
  unsure 15: a, t, c, g, or other
aggagggctcaatcnacaggtttaaatggtgtgctattcataattattgcaaaaataggccgggc

SEQ ID NO: 7254 - DNA, 292 bp, Zea mays
  misc_feature: Incyte ID No: 700381423H1
  unsure 2, 9, 87, 286: a, t, c, g, or other
cncacgcanccgccctcagccaggtgcgcgcgtcttctttgggcccttcgctggtgacgagcgcccactaggatcgaggcgtggtgntggtcgttgggtacttccatttggtgataatctgtgtgggaggtggaattcatggacgttgttaccgggcccaagtttaatcctagcaatttcagggtttctggtgcctgctcattctgaatggcagaccttacggacatcggttgctgcagttgctttagctttttaaggaagcccagtgtacctgtacgtcaacatnaggatg

SEQ ID NO: 7255 - DNA, 294 bp, Zea mays
  misc_feature: Incyte ID No: 700381424H1
catatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgta

SEQ ID NO: 7256 - DNA, 276 bp, Zea mays
  misc_feature: Incyte ID No: 700381427H1
cctccaatcccgccagtccggcggcgacccagggatccatggagaggtacgaactgctcaaggacatcggttccggcaacttcggggtggcgcggctgatgcggaacaaggacaccaaggagctcgtcgctatgaagtacatcccgagggggctcaagattgacgagaatgtggcgagggagatcataaaccaccgctcgttgcggcaccccaacatcatccgcttcaaggaggtcgtgctcacgcccacgcacctcgctatcgtcatggagtacg

SEQ ID NO: 7257 - DNA, 51 bp, Zea mays
  misc_feature: Incyte ID No: 700381428H1
  unsure 4, 8, 35, 41: a, t, c, g, or other
gtgnttcngagcaatcctgtctaacctattttctnagacantcaaactctc

SEQ ID NO: 7258 - DNA, 294 bp, Zea mays
  misc_feature: Incyte ID No: 700381429H1
gattttgtggatgcaggttggccatcttgaggaacggtaccaggaatgggttcaccaaccgatcgtcagcaaggagggtccacgctttttcggaaatgatgtcctggagttcttgactcgcacgaagtgtgggctgtgccaactatatggctgcctgttgtctgctgcctgctcgtgaaatctattctgatgggtcatactgttcaggacgtagctatgatggctctgtttgggatatttatttggacgctgatcgaatacactttgcaccgcttcctgttccacatcgagacc

SEQ ID NO: 7259 - DNA, 131 bp, Zea mays
  misc_feature: Incyte ID No: 700381430H1
  unsure 42: a, t, c, g, or other
ctgaggcgcactagcctgccttcgttttcacagttaagctgnagttattagtatcagctttcttgaactgtttggtatgtaatccaggtccctgatgtctgactgttttaattgcaatattcatcaccctg

SEQ ID NO: 7260 - DNA, 181 bp, Zea mays
  misc_feature: Incyte ID No: 700381431H1
  unsure 24, 103-104, 155-157: a, t, c, g, or other
gaaagccattgtacagcatcatanccaaacgctgttcaatggctttctagtgttacacaatcaaccattgaacagcgtttggctatgatgctgtaccatctgnntttacatagctccttttgttttagcgatgtcattgtcatgcatcatgagtnnngtctacaaacatttgtaagaaaaa

SEQ ID NO: 7261 - DNA, 298 bp, Zea mays
  misc_feature: Incyte ID No: 700381432H1
  unsure 7: a, t, c, g, or other
gtttgtntggatacagctcctgccactgcaacaatagtggttacagcatttgatcgctgggttttgttcttatgttaaattttcagaacttagtttgtacgtaacttattggataggatgttctagatctccgagtcgactgccttgcaagccattcatcagctggagttggacggcagtgttactttaacttataatatcagtgaagctgatgcagtgatcgcgttacattcaaagctcaagaagaactctcagattcaggctgtgctgaaatctcaagatataccggttttcctcg

SEQ ID NO: 7262 - DNA, 298 bp, Zea mays
  misc_feature: Incyte ID No: 700381433H1
  unsure 66-67, 69, 71, 95, 213: a, t, c, g, or other
cctcctcgcgacggtggcatcggcctcggccaccgtctacgactgccgcacactcgctgtaatcanntncnctcgagctcgcgggtctcctcgcngctgcgctatcgcccacgggggcgtatctgcagaccttccagaagtcatcctcgccgcaggagaagaatgtcacggtctggcacgtcgacacagctgccgctctttaccaacactatnagaagagcatgtctaaaaccacctggccaatggttcagttttctgcggatgaatcggtcgcttgccggatgatgcctaatgagat

SEQ ID NO: 7263 - DNA, 293 bp, Zea mays
  misc_feature: Incyte ID No: 700381434H1
attcatcggacgcaagtataacacaagcttggcttgggaggaggaagcacaaggagctattgccacctagcaaaaggataaaagggaggatgacgaattggcgatgtgtttgtgacacgctgccctcaagtgtggatgatgagtgcagatatgttggtgactgtgccaaggctgtcaagtgtgtaaacgaacgctgccttcgtagttctgacaactgcgactgttctgtagctaaacctatttgctatctttatgataaagttatctaaatgggacggtccttgaccgattaa

SEQ ID NO: 7264 - DNA, 288 bp, Zea mays
  misc_feature: Incyte ID No: 700381436H1
  unsure 107: a, t, c, g, or other
aggttctgcacaatcaggagtatcaggcctgatagtacctgcagcaactgtaggagcactgggttacggttatatgtggtggaaggggatctcgttctcagatctantgtatgtcaccaagcgcaacatggcaaatgctgtttcaagcatgactaaacatttggagcaagtgcaaagttctcttgctgctgctaaaaggcatttgacacagcgcattgaaaagttggacgataaattggatcagcaaaaggctctatctggacaaataagaaatgatgttactgatgc

SEQ ID NO: 7265 - DNA, 289 bp, Zea mays
  misc_feature: Incyte ID No: 700381437H1
  unsure 123-146: a, t, c, g, or other
aggaagaggcatgcgcggagaagaagtacggagggatggcacccaagaagcccttgatatccaaggaccacgagcgcgcctacttcgattctgcggactgggtgctgggcaagcaagccgcgnnnnnnnnnnnnnnnnnnnnnnnngcagccgcggtcgagtctctgaagcccaagctgaagagaacgccgcaccaccagctgccgcctcgtaagcccacctgcgcttccagttgagacgcatggccacgcgtcgcagctgctggaggaggagctcggtcagagtcaag

SEQ ID NO: 7266 - DNA, 285 bp, Zea mays
  misc_feature: Incyte ID No: 700381438H1
cacccaatgtcgcgtgcggccactagatttttcctgacgcggtgtctgctcccacttcccctcctctcccccaggtggcggcagggcggcggggtagcatttgtgctacgagggcttttgcaatggcggcttcggggttcggcggcggcgaggcgttccggctctcggccgcaccaggggccggcttactgaagctgcacaagggcgacatcaccctctggtccgtcgactgcgccaccgacgccatcgttaatgctgctaatgagcgaatgttaggtggcggag

SEQ ID NO: 7267 - DNA, 287 bp, Zea mays
  misc_feature: Incyte ID No: 700381442H1
  unsure 254: a, t, c, g, or other
ccgcgccgagtccgctcccccgcttcctgatactcctgctcgccgtaacctcctccgcgtttgccgccgccgcgcaaccggggctccggtggtgggggaggactacgtccgtccgccgccggcgcggtgccaccgcaaggcactccttagcctcttcccttggagcaagaaggaggagtccgccgcctcctccgatccgcagcaggtgcacatttctctagctggagaaaagcacatgagaataacatgggttnccaatgataactctgtcccatctgtggtggact

SEQ ID NO: 7268 - DNA, 80 bp, Zea mays
  misc_feature: Incyte ID No: 700381443H1
cttgggaagggcctagaatggaattggaagggtagtagagtatatagggaaggctgtggaggtgtaaaatggctcataga

SEQ ID NO: 7269 - DNA, 290 bp, Zea mays
  misc_feature: Incyte ID No: 700381445H1
  unsure 6, 8, 10, 25, 28, 38, 59-61, 73, 82, 86, 89, 139, 150, 154, 156, 166-167,: a, t, c, g, or other
aacatncngnagacttcttgcaagngantgaaaggcanacatttgttgggccgcccgannntgtgagggaccntgtaattgntgcncanaagagccctcaacaagggtgatcaccaaaaggctttcagtgtcataaatncgttggagatntggnancttttgaggnncagagagcatgtccttgagatgttgangcttaagatcaaggaggangctcttagnacctatntcanttcatactcgtcctcgtangagtccttaagccttanccagctcactancatgtttga

SEQ ID NO: 7270 - DNA, 291 bp, Zea mays
  misc_feature: Incyte ID No: 700381446H1
caagatcgtaaatcagccgagtctgcagctaaactggcggcagcaagtgcagaaattcaagagcttaaaacaagaggcggctcacgcatggaggcaaaagaaatatgttctgacaatgagaaacaagatgttgaggtctccaaagggaagcaagtccagatcatgaaggatattgagctggaccaaatatctacttgccctccatatggcgctggagctgccctctacccccatggaactggtgcaaatgctgaactagatgacgatatgcttcagctgtgggaggctgcg

SEQ ID NO: 7271 - DNA, 290 bp, Zea mays
  misc_feature: Incyte ID No: 700381447H1
gtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgccgaatcaattctggaagcaacccttgttcatatgggcgttaatgaggaacataattctgctggtctggccagtggaagcttctgtgtctccattgttggtcaattttgtgtgttttcggacgagatgggagtaattgaactgtagaaatta

SEQ ID NO: 7272 - DNA, 301 bp, Zea mays
  misc_feature: Incyte ID No: 700381450H1
  unsure 226, 229, 255, 275, 282, 292, 295, 297: a, t, c, g, or other
attgtgagccttggctgtatttgattttaagtttgaataatccacctgctgtaggtagtttggttaaaagacattgctatttttctgcttagtgatactgatattagttattcatttctcgtccatctatttttgaagtgtcagtagtggtttgttaaacttgttttcctgagcttgcttctgattctggcaagtttttgggctcctggcacttccactttaaganctnatttgattggttaataacaggaaagnggttcctgactggagtatgncctacangggtatgcanagncnattg

SEQ ID NO: 7273 - DNA, 300 bp, Zea mays
  misc_feature: Incyte ID No: 700381452H1
  unsure 9, 13, 26, 30, 38, 64, 74-75, 81-82, 110, 120, 136, 152, 163-164, 205, 216,: a, t, c, g, or other
gccgcacgntgcntggagttactgtnaaanacgtgaancagcaggagttcgtcagagctctggnagccttcctnncaaaanntccgggaagctgaaagtccccgaatggntggataccgncaagctggccaagcanaaagagcttgctcccnacgatgagaannggttctacacgcgagctgcttccacagcgcggcacctgtanctccggggtgncgctggggttggctccatgaccangatctatgggggacgtcagagaaanggggtnatgcccagccatttagnngnggctccaag

SEQ ID NO: 7274 - DNA, 294 bp, Zea mays
  misc_feature: Incyte ID No: 700381453H1
gtgaagctaaccgggattccgggaagcagagacgtccgcccgtcgcccgtcgtccgtcgtcatggccgccgtggaggtgtgcgtgaaggccgccacggggaagcccgacacgctcggcgactgcccgttctcgcagagggtgctgctcacgctggaggagaagaaggtcccctacgaggtgaagctcgtccgacctcgacaacaagcccgaatggtttctgaagatcagcccagagggtaaggtgcctgtgttcaacggtggtgatggcgaatgcattgctgattctgatgtaa

SEQ ID NO: 7275 - DNA, 229 bp, Zea mays
  misc_feature: Incyte ID No: 700381455H1
  unsure 152, 203, 211, 223: a, t, c, g, or other
tcctttgttcctacatagtttaaattgtcacaattctttgtgatggaatggaagaccagtaccacttctttcaacagtaatatcaaatgccggaactgtttttttaatacagactctcattagaccatgtttggagtttgtttacttttgangtaatttagaataagtgatgcgatggtatctgtgtgcttgacatctgaganggcgtggncgcaaaaatatngtttgg

SEQ ID NO: 7276 - DNA, 170 bp, Zea mays
  misc_feature: Incyte ID No: 700381459H1
ccctctcaggtgataggcatgcacttcttcaaccctcctccggtaatgaaactgatcgagattatccgaggagccgatacgtcagatgaggtgtttgctgcggtcagatctttctccgaaagactcgggaagtccgttatatgctcgcaagattacccaggattcatcgg

SEQ ID NO: 7277 - DNA, 285 bp, Zea mays
  misc_feature: Incyte ID No: 700381462H1
  unsure 30, 97, 249, 252, 260, 267, 274, 280: a, t, c, g, or other
gtcggagggaaccgaaaactcaggtgaggncttcttccgccgcacccgccgtcttatccgaactccttgacccgattggcgcgattcgccgtttgtnttcccgaatcggcgacgggatccgcccgattcggccgtcgatctgcgctgattcggcccgcgcgccgtcggggttcgctttcttctgcgcagggtctcgaatttctaggagcggaggcgatggctgggaagggaggaaaaggattgctcgcngcnaaaacaangggggcnattcggnggaaanggaaa

SEQ ID NO: 7278 - DNA, 290 bp, Zea mays
  misc_feature: Incyte ID No: 700381463H1
  unsure 23, 41, 43, 49, 93, 97, 108, 146, 163, 175, 184, 209, 226, 252, 274, 281: a, t, c, g, or other
ctcggacttgtctcccccgagtntagtgtcgcacacctgcncntcctcntcgtcggactcggctcccccctagagccgtgtcgcacgcctcangtanttctgttctcngaggttcctttggtttggttctgctcaaggtttacganggttgcctatctctcgntgctggggctcngtgatgtcnagaaggtcatgtctagtaggtccangaacgatccaagcaaantggtcatggggtagctgaaagcattntgcgtggtttggatatagctancatgggntcagtaggg

SEQ ID NO: 7279 - DNA, 226 bp, Zea mays
  misc_feature: Incyte ID No: 700381468H1
  unsure 151, 190, 219, 221: a, t, c, g, or other
atggccacgatctgcccaaggccaggcacaaggcagtcgtcggccttcaggttcagggcctctgctcatgggagcggttcctcaccaaacctctcctccttcactgctgtgacaggcaagaaggttaaggtgttcgaggaccagttgaganggatcgtgtgctaaaagagacgaggacggggaaatggtntgcgaggggtaaggaggaaggcccaaggntnggaat

SEQ ID NO: 7280 - DNA, 293 bp, Zea mays
  misc_feature: Incyte ID No: 700381470H1
  unsure 215, 244, 272-273, 277, 280-282, 284, 286: a, t, c, g, or other
gctcctcaggcagataatgcttccaagattgaagctccttcaaaaggacctgtccagttgcacaaggcaaaagctgctctcgatgctgatgatgattatgaggccgagcccccgaaggagaaggcaaagcctacgggggctgatgtggcgaagttgaaagagatgaagaggcaggaggagattgagaagaacaagcttgccttggagaggaagangaggcaggctgagaagcaggcagcaaaanctgtggccccgagcacagaagggaaccnnaaanaannntnanaaagggg

SEQ ID NO: 7281 - DNA, 289 bp, Zea mays
  misc_feature: Incyte ID No: 700381471H1
  unsure 185, 255, 281: a, t, c, g, or other
atctagttaaatatcacaaatttaactagatctgctaggggtaagtgggatggctgactcaggcctaaccaacgaaataagatagtcatcaagcgtaaatttgtgatattttcgaacttgtcaattgttgggatgaatgtgagcttgatgtggaactctgttggcttttatcagatagcaaagcngtgcatgattacctgcatcatgtcttctggaggttgttttggatccaggtaccattattcccgggacacnaaagcgagcataatgggccggcttangggggtgc

SEQ ID NO: 7282 - DNA, 280 bp, Zea mays
  misc_feature: Incyte ID No: 700381474H1
gtggcccaggttatgttgggaacccacactacatgcctccacggccacaagagaactattatcctcctcccgatgtgccccctgtagaaaagcagccacactatggaatttcttcatatggacgagatgcacctccaagtgctcccccagggaatcaaaaccaagcacatgggtcatctcaggtgacacacagcatgcaagttcctctttcctatgctgatgctgtgataggggcagctggtgccagtatcagctacatccgcaggcatagtggagcaat

SEQ ID NO: 7283 - DNA, 176 bp, Zea mays
  misc_feature: Incyte ID No: 700381475H1
  unsure 48, 52, 63, 81, 122, 127, 132, 160, 162-163: a, t, c, g, or other
caaaggtggaaagatacaggaagcaaagattatatttaatgaaatganaganaaagaagtcanatctgttatccagctacnccccataccagacctgacttctttttctttcatttcattanatatnaagangtcaaatctggtatgggatgtagctggntnncagttaagctatt

SEQ ID NO: 7284 - DNA, 275 bp, Zea mays
  misc_feature: Incyte ID No: 700381479H1
  unsure 115, 126, 269: a, t, c, g, or other
agctgtacacctgtgccattgcattgaaccaacaaaatgccatttactattgcaacagggctgctgcatatacccttcttaatatgaacaacaaagctattgaggactgcctgancgtcaattganattgaccctcactacagcaaagcatatagccgactcggatctgcttattttgctatggggaattatcacgatgctctgtacaagggatacttgaaagccgccgagcttgatcccagtaatgaaaatgtcaggcagattatggnggtccc

SEQ ID NO: 7285 - DNA, 171 bp, Zea mays
  misc_feature: Incyte ID No: 700381480H1
  unsure 7, 11: a, t, c, g, or other
gcctgcntgcncgggggtcccgccctccgtcctcgtggaccccgccacccatcgatactaccgatgcctccggtcgcgtcgccatcccgccgtgtataaagcgccctcgctccggccaggtcacggctcccgttccaactcctacctacgcagcagaggccagcaacctcc

SEQ ID NO: 7286 - DNA, 297 bp, Zea mays
  misc_feature: Incyte ID No: 700381481H1
  unsure 43, 48, 54, 113, 142, 219, 257, 260, 279: a, t, c, g, or other
cagcagcagtagcagcacctaccagcttgttagaaatgcagantctcnggcccnccttcagacccactgaaagagaatcagcagtttaacaagatctccggaggctgtggggnagactcacaggcagcttaaagtttcaggngctctgctttaagaaacattcctttcagagagggaacttaaactgagccaagatctaaaaaccatgtgaatcccaanttcagagaatccagggtcagtggtccaccagaaccggnggntataataattggttataanccatcctaatggtggggg

SEQ ID NO: 7287 - DNA, 287 bp, Zea mays
  misc_feature: Incyte ID No: 700381482H1
  unsure 266: a, t, c, g, or other
ttatgaagaccgtatcagtggggaggaggaggttcagtgcagagttccagctagtgttccggctgatcaagggtctcatatttataacttttacagccatcgtggtaatcctaatagcaatccctggcatgacggttctggacatctttgtttgcatccttgccttcatgcccactggatggggtttgctcctgattgcccaagctatcaggcctgtgattcaaaagatcgggctgtgggggtcgatcaaggctcttgcccggggntacgagatcctaatggggctt

SEQ ID NO: 7288 - DNA, 181 bp, Zea mays
  misc_feature: Incyte ID No: 700381486H1
  unsure 2-7, 12-15, 17, 21, 24-25, 38: a, t, c, g, or other
gnnnnnnatccnnnngncctnaanngtgcactggtttnaattgtgttggtgtcggcccctcacaaatgcagccaagtcatgtaattagtcatctggaacaaagactaaaaacagcagagaattgcgggttctacccagtcagaagatcacaccatggagactttctactagaggactgaaa

SEQ ID NO: 7289 - DNA, 274 bp, Zea mays
  misc_feature: Incyte ID No: 700381487H1
  unsure 23, 175, 178, 187, 190, 199, 203, 224-225, 227, 243, 251-252, 254, 258,: a, t, c, g, or other
attgagagcccaggaagtgaganatgagcctgcagattccggtgagatcaggcgccctgcgccgccttctccttctaggtggcgccgagggtctactgcgcacctactccaccggcgaccggcgccggcgggtgatccgcgaggcaaggcaagaggaggaggacgaagcgttctncgnaccctcaanttnggcgctgancccngagaaaaaccttttccccgcnngncgaggatggcagaggnttttcganncntagncgggaaagngnatcgc

SEQ ID NO: 7290 - DNA, 61 bp, Zea mays
  misc_feature: Incyte ID No: 700381488H1
  unsure 17, 24, 41, 46, 48, 54, 57: a, t, c, g, or other
gtgagccaaggtcacancattgcnctccaacctgggcgacngggcnanacttcngtnctac

SEQ ID NO: 7291 - DNA, 274 bp, Zea mays
  misc_feature: Incyte ID No: 700381490H1
  unsure 21, 190, 193, 197, 206, 208, 220, 226, 238, 247, 249, 252, 259, 262,: a, t, c, g, or other
caggaaatggcggcgactganggcgtgctcttggggatgggcaaccccctcctacgacatctccgccgtcgtcgatgacgccttcctgacaaagtatgacatcaagctgaacaatgctattctcgctgaggagaagcacttgcctatgtatgacgagttggctagcaagagcaatgttgaatatattgcnggngganccacccagntntctatcagggtngcccantggatgcttcanactcctggngnaanaattagnggnatgcannngaaa

SEQ ID NO: 7292 - DNA, 150 bp, Zea mays
  misc_feature: Incyte ID No: 700381491H1
  unsure 7, 34, 95, 103, 106, 121, 140, 143, 148: a, t, c, g, or other
cacccanccactcgcttcagccgcctccgccgcncgtacaagcaggtggagacaggatgccggctggccacggcctgcggctcgggacgcgcganctcttcgngcnccccttccgcaagangggctacatcccgctgcancanctacntc

SEQ ID NO: 7293 - DNA, 272 bp, Zea mays
  misc_feature: Incyte ID No: 700381492H1
  unsure 62, 138, 172, 239, 250, 254, 261, 265: a, t, c, g, or other
ccgagacgaagaagtccgccgtggcgcctgctgggaaggctgcccagcctgcggcgaccacnaagttcccgaccaagcccgctcctccctcgcagacggttcgggatgcacgcggcggtggctcatcagctcgtggangctttggccgtggtgaacgtggccgtggcagagntggacggggatatggccagaaccgtgggcttaattggtgacaatggcaatgaattccagggaagttntggtggccgangctntggggantgtncttaact

SEQ ID NO: 7294 - DNA, 275 bp, Zea mays
  misc_feature: Incyte ID No: 700381494H1
  unsure 78: a, t, c, g, or other
gcagcgccgcctggatcgagcagccgagcgactaagcgaagactcccttttccccgagcacaagagaaccatggcggnggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtccggatccctataaggttctcca

SEQ ID NO: 7295 - DNA, 309 bp, Zea mays
  misc_feature: Incyte ID No: 700381501H1
  unsure 3, 16, 18, 24, 31-33, 60, 84, 116, 119, 121, 123, 125, 127, 138, 140-141,: a, t, c, g, or other
tgngatcacacctgancntatgcnaaaaggnnnggatgactcaaagctggggctggtcancagacagactgaccatgtgattanaggtttgaggctttgagtcagcctgacctatnggncngngnantggaggctgantnnaatcatctngccagtgcnntantcannaccncngcnnngaccctaataaaaactctggacactaaagctcagcatanntcctgggtggtgaagctgtggctatgccggcagggcagtgtgcctaattccacgaagagggggcatgggagcactgtgctcaagaccttc

SEQ ID NO: 7296 - DNA, 309 bp, Zea mays
  misc_feature: Incyte ID No: 700381503H1
  unsure 200, 242: a, t, c, g, or other
gtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacganaaagagcaaccatgtcacgaggaagcttgagaagcgcaaggngggacgtacccttgacccacacattgaggagcaatttggcagtggacggttgctggcatgcatttct

SEQ ID NO: 7297 - DNA, 308 bp, Zea mays
  misc_feature: Incyte ID No: 700381505H1
  unsure 29, 36, 56, 62-63, 66, 70, 72, 74-75, 103, 116, 140, 142, 156, 267, 284,: a, t, c, g, or other
ctattttctgctcatcagcttgtcctctnggctcgnttggcccgaatttccatcgngtcgtnnatntggncnannatcgtcgttagtcgtcgtactgtgcatncaacagccccgantctatgtcgccccggccttgttgncnatatcgctcgccgnagctcagcttgctagttcgtcgtgccgcgtcatgtgctgatattctcttccggcaggtctcgccgtcgaccatgtttaagtgattgttcggctcctcgcatcccacctatncaataaaacacccaaanccatagactgtcgangcactgctg

SEQ ID NO: 7298 - DNA, 308 bp, Zea mays
  misc_feature: Incyte ID No: 700381507H1
  unsure 196: a, t, c, g, or other
atgaattttagtttcttattccataagttttgtgaaagcccccaagtaactccaggagaacctatctaataaaaatgtttagtgatcctagcacttggaagatgggacaggagaatgaggaagttaaggccatcttttactacagtgtgacttaaaggtagcctgggctagatgagatgctacctcaaaaaaccanaaagtttggtaagaagaaatctggggccttggccttcacagactcgctatctcgtttttatcacactctcatttcctttgtgttcgtttacagtcatgcctttccttgatgt

SEQ ID NO: 7299 - DNA, 307 bp, Zea mays
  misc_feature: Incyte ID No: 700381508H1
agctggcaggcacatgacacatcgccccagccccaagtccaaagccgcgagaggcaggggcgcagaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagcta

SEQ ID NO: 7300 - DNA, 305 bp, Zea mays
  misc_feature: Incyte ID No: 700381510H1
gaccgacgcctctccgacgagcaactcaaccccccaccgcgcacgcgagagccggatccccacgatggcgacgatccagcaccaggcgaaaccggcggtggcggcggcgccgagcacgactactggcggtgggcagcgcgcgatggacctctacgagaagctggagaaggtcggagaggggacctacgggaaggtgtacagggcgcgggagaaggcgacggggcggatcgtggcgctgaagaagacgcggctccccgaggacgacgagggcgtgccccccaccgcgatgcggaggtctccttgct

SEQ ID NO: 7301 - DNA, 305 bp, Zea mays
  misc_feature: Incyte ID No: 700381511H1
  unsure 23, 47, 50-51, 142: a, t, c, g, or other
ctcagtccacaatgatgcatgtnacatctcctgctcctactctttgnaanncaatgtttagttcctcgaatgtgctgggccaactctctctcgagaaaccgattttgatgcatccatgaggtcggcaacatgggataactcntggcagcctgctcgttcgggaggacttctggacccaagtaagctgcctgatttatgtgctcaggatgataggaaatatgcctttgagccacttttcatactagcagaccctgggtctgccgatcttaatgctttaatggaaccatcaaaatctggagcagatg

SEQ ID NO: 7302 - DNA, 305 bp, Zea mays
  misc_feature: Incyte ID No: 700381513H1
  unsure 10, 18, 29, 31, 42, 45, 53, 56, 71, 87, 92, 100, 103, 111, 124, 177, 201,: a, t, c, g, or other
caaaaaacanaaccctgnagtgttaggantngagtgaaggtngangggtgagnaanggtaaggggcatgtnctgatttgcagctggnggtcncaccagcnacncctttcancctctacaacagngcagcttcccagacttctccaggaacccagaaacgggatggttgtcggcaaangttgggagtggcttttcctctggnagccncacacctgagcactacngacanggaggcaggtgccaccttgacacctctcttccatagcaatgggaaagttatgantgcnnggagtgctgaggagatgt

SEQ ID NO: 7303 - DNA, 307 bp, Zea mays
  misc_feature: Incyte ID No: 700381515H1
  unsure 13, 39, 48, 58, 62, 96, 191, 194, 208, 211, 234: a, t, c, g, or other
agcagatgcgtanagttgctgtcatgggttaattgagantagaaattngcccctggcnaatngcacacaccttcatgctcagcctcacgaaactgncaataagccttcgaaaacgaaattgtccttgaagcttgtatctgatatcagcactggattgtagaacttgttgctgattttgaccttgtattgantcnaactgttccccttngtnttaacgtgtcagggctgagtgtnctgggatttctctagaggctggcaagaaccagttgttttgtcttgcgggtctggtcagggttggaaagtccaa

SEQ ID NO: 7304 - DNA, 305 bp, Zea mays
  misc_feature: Incyte ID No: 700381517H1
gaacgaacgtcacaaggttatcaatagtaagcttgactgaccttgagttgaacaaaaactttcatgaagacgtatctttggcaatgaattggacaggtaaggttcaagaacacttcagctaaataaatgagtagagttaacatatatctttctcaagggatgggggactaggggagtcactagcattgattgtgcaccttgaatccctttcttttcttatataaggaggtatcctctacactaaactacgaacaagtatcagagacactctctgtcaggtgtctgcaatggacaacctcaaaacc

SEQ ID NO: 7305 - DNA, 301 bp, Zea mays
  misc_feature: Incyte ID No: 700381519H1
ctttaggagccatatcttctctaattcgtcataaccagcctggagtttccgcatttcgattgggaaatggctatgctggattgaaggatgctcttggttccgatgatgccagactccaaaggaaagctctcaatctcatacaatacttgctgcacaactacaaggcagacaggagtgttgccacagagcttggtcttccgaagctgatgatgcaccttgtgtccagcgatgattccttagtgcgtgaagtgctctaggcggcctccttgagttggcgcgggacaagacatctggtaacgcg

SEQ ID NO: 7306 - DNA, 301 bp, Zea mays
  misc_feature: Incyte ID No: 700381520H1
  unsure 141: a, t, c, g, or other
ggtgcatggcaccatgcattggtacactgattaagctgatggaggtggctaagccagcaacaatacaggagtcagctggtcgtgcactgcttgctctgtttaccttgaagtctaataggaagggttttgtcagggatgagnagagtttaacaatatttgtgcggatgcttgatccccggtttcaggagactgataagaagtatccactctcgatctttctagttcttgccatgggtggcgggaacgggacacgacgacgacttgttgatgctggttcttgtcagcatctacagaagctggc

SEQ ID NO: 7307 - DNA, 302 bp, Zea mays
  misc_feature: Incyte ID No: 700381521H1
ggtgaaaagaagatacttagcataaaaatttccaaccatcaattttacaagcttttacctgtaaaagttgaccaggaacagctagatgagttggaactggaagctaaaatacaaggaacaaaaatatctaatgtctgcgtccaggttgctgaaactggtcagagtgagtcactctactgtaataactgtaagctctcgatgagccgattattaaggtgctgtccaacatgcccgtttaagctgtgcctaagttgctgtcagaagatacgtgaaggaaacacgtcggacaacacccctgaaga

SEQ ID NO: 7308 - DNA, 301 bp, Zea mays
  misc_feature: Incyte ID No: 700381522H1
gtgattcacatgtctaactcccgaaaagaaggcagaaggtcctttttatagctttcctcagtctgatgtgtgcttccatccttcgctttcgaaatctcccttgtgtacaccattgcaccaccaccctttaatcctttactatccagtccgttattccgcgagtacgttgatgatccctccttacggcagtaaggattctgcaaaagtgtgcttcagctatgcagttcagcagcgtgcttcccctagagggaaaagcgtgtatgagcccagtgaggagaggcagtggaggttatgggagtga

SEQ ID NO: 7309 - DNA, 301 bp, Zea mays
  misc_feature: Incyte ID No: 700381524H1
  unsure 43: a, t, c, g, or other
ctagccgacgccgccctcaccctgtcacccaccgacgtcgccntcgccgtcgccgtcgccacctatatcacccaccgcctctgaagaagaagacgcggatccgagggtagttaactgctgaggaagaagagccggtacggagaagacgcggagcagtacgtctccgatctggatgttggtaaggttcatcctgatttgaacggcaagctcactgataacgagttcctgggaggaggaagctagacgatttctgttagaggaggaagaagaggatgatgaactcttcttagtacttgtccct

SEQ ID NO: 7310 - DNA, 301 bp, Zea mays
  misc_feature: Incyte ID No: 700381525H1
  unsure 60, 107, 146, 190, 204: a, t, c, g, or other
gcgcgaagttaagccaccatgtggacgagggctttagcgacggtgctgttcgtggcaggngccgcgctgctcggcgtcggcgtcggcggcgccagcgcgcagcaggngcgtgtggagcatcatcactcgtcccatgttccagagcntgctgagccaccgcggcgatagcgggtgccagggcgccttctanacctacgacgcctncatcgaggccgccagcaagttccccggcttcggcaccaccggcgacgagcagacgcgcaggcgggagtcgccgccttcttcggccagacgtcccaac

SEQ ID NO: 7311 - DNA, 298 bp, Zea mays
  misc_feature: Incyte ID No: 700381526H1
gagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctacatcgagcaatacgagaaggattcctccaagaccggcagggattcacaggaggcccttgctc

SEQ ID NO: 7312 - DNA, 299 bp, Zea mays
  misc_feature: Incyte ID No: 700381527H1
  unsure 89: a, t, c, g, or other
ccttctcccgatccgtcagtttcgccagctgaagacgatcccaatctcagatccaactaggaactcacccagcgctatctcccggcagnctccccgttgactcccgcgatttgttacccgctggcgctgccgcacacagctcaaaaggagtagcagcgcccctggttgccggttggagcgtcaaggatgagcgggaggaagaatgcgggcaaggtttccccctggttgctcgtcctcatctgtttagggtgcttctttgtgacctacaacctcctgacgatgcccagccggggacggga

SEQ ID NO: 7313 - DNA, 296 bp, Zea mays
  misc_feature: Incyte ID No: 700381528H1
  unsure 14, 74, 275: a, t, c, g, or other
gcagataatactgnatatggaactatatgcatgttgcattgagtatttgatcttagagagcgataacttatcanagttgttcccaaatgcacacctaaccatgggtaacttgactctggattcacatatgctatttgccatcttgactgctcttgtcgtcatgcctaccacttggcttcgtgatctcagctgcctcagcttcatttcagctggtggagtcattgcatctatcgtcattgtctcctgcttgttctgggtgggacttgttgatcacnttggcacagtcgagagtgaag

SEQ ID NO: 7314 - DNA, 298 bp, Zea mays
  misc_feature: Incyte ID No: 700381529H1
  unsure 37, 96: a, t, c, g, or other
gggcctacgcgcagaaccacctccaccgcgacgcgtncgaggtctacgtccgcatgcttaggtgcctcccgcacccttcgactgctggcttctccntcggcgaccggttcacgtacccgttcctcctcaaggcctgcggcgcgctcgctgcttctcggctcggcaggcaggtgcacgcgcacgtggcaaggtccgggtgcgagtcacacgctgtcgtacagaactccctgatcgagatgtacacgcgctgcggggatctgtcgaccgcacgcaaggcgttcgatggaatgcgggagaa

SEQ ID NO: 7315 - DNA, 207 bp, Zea mays
  misc_feature: Incyte ID No: 700381530H1
  unsure 24, 53, 65, 68-69, 82, 88, 97, 102, 121, 126, 138, 176, 186, 190-191, 194,: a, t, c, g, or other
acaatgcatcgtaaaaccttcagnaggaaaggagaatgtctcgtgctaccacnttggtgttcttnttnnccgtgtggcagtnttaagngattagttnttaanatcagtacattttaatggnaacancttgaccaaaantttgtcacagaattttgagacccattaaaaaagttaantgagaaaaanaaannaantnannatgtnaga

SEQ ID NO: 7316 - DNA, 295 bp, Zea mays
  misc_feature: Incyte ID No: 700381531H1
  unsure 104, 194: a, t, c, g, or other
ggggggttccgtggtggttacaacggcggttatcggggaccagctgctgctccagcgatcgaagaccaggctcagttccctgccctggcctaagcacagctcgngttctcgctcaagattgtgtcacttttgcggagtgcgtcagtcagtcctagtgttgttgctcccaagcttgctttccggattatgtgtanccaacattttctgatgttatgtactggtgtgctcgtgattgcatggttttgctaagctcagctgaggggtgtcgtgttctgtttgcctggctgatggctgt

SEQ ID NO: 7317 - DNA, 297 bp, Zea mays
  misc_feature: Incyte ID No: 700381532H1
gaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggtttttttttt

SEQ ID NO: 7318 - DNA, 298 bp, Zea mays
  misc_feature: Incyte ID No: 700381533H1
gtccccgagtcgacaggccacaaatcccaattccaaaaccttttctccgtcccatcgccggcgatcttctccttcgccgccaatggatctctccgctgtccaggctgccctctccgacaagtcctactccaccctcgcctccctctgcgacgaacttctcctccaggccgcgtcccagggattcaccaccgacgaatggccctactctgtccacctgcttgcccacctctacatcaatgacctgaacagcgcgcggttcttctggaagtcgttgccgcaggaggtcaaggacacgcgg

SEQ ID NO: 7319 - DNA, 294 bp, Zea mays
  misc_feature: Incyte ID No: 700381534H1
gcttgctttcactgtgctggaagcattgtgaaatagaagttccgctgatatctgcctgacctggatggtgtatatagatgcaagcagagggggcaggcccacaggcaatcacgccgttcttgtctttgtacatgaaaggtgccaggaggttaagtttagctggttatgtaaaggtccgctttttgaggacctgtccagtggatcaatcccattcctagactggtttgccttgaggcttggagattttgtagtaagactattagttcaattgagctgtttgtccagttgatgagt

SEQ ID NO: 7320 - DNA, 296 bp, Zea mays
  misc_feature: Incyte ID No: 700381536H1
gaagataggaaaaaggcccgaatatttagttcaagggactttgtaccctgatgtaattgaatcatgcccacctcctgggagtggaaggacacattcccacaccatcaaaagccatcacaacgtaggtggccttccaaaagatatgaaattaaaacttattgaaccactcaagctcctattcaaggacgaggtgcggaagttggggggtattttgaatgtcccagattcatttttgaagcgacacccatttcctgggcctggtcttgcagtacgtgtcctaggtgatgttacacaag

SEQ ID NO: 7321 - DNA, 286 bp, Zea mays
  misc_feature: Incyte ID No: 700381538H1
  unsure 51, 99: a, t, c, g, or other
cataaatcaggaaatattgacgatggaagcaatggcgacgtagctgctgancattatcatcgatacaaggacgacatagaaatgatgcattcgattggnctcagctcctacagattctcattgtcgtggtcgagaattcttccaaagggtcgcttcggaggtgttaatcaggcaggcgttaaattctacaatagcctcatcaacggactgctagaaaaagggatacaaccatttgtgacgatcaaccactatgacatacctgaagaactccaagaaagatacaatt

SEQ ID NO: 7322 - DNA, 293 bp, Zea mays
  misc_feature: Incyte ID No: 700381539H1
  unsure 2, 22, 51, 105, 113, 115: a, t, c, g, or other
antaataagggaactactccanaccctctacacatccttatgtacactggnccaaagagtcggcaagtctgtgctggtcgggaacattaacatgtgggtgtatcngatggacncnagcctccactggcagcagcagctgaacaacattcagatcaccagggtaagcgggcaggcccagcctcctcccggcagagggtccctccacagggatactggacagactcgccaagactttgaattcactcctgtgacggaagagtctggtcttttctgatctgctgctttgttctggt

SEQ ID NO: 7323 - DNA, 271 bp, Zea mays
  misc_feature: Incyte ID No: 700381540H1
  unsure 92-110: a, t, c, g, or other
ccaatccaccacccagccatgcctcccaagcgcaagtcccccggcgacgattgccactgccgcggggtccccgaggaagacgcggagcatgnnnnnnnnnnnnnnnnnnnggaagcgggcaacggagcctgctccggcgaaggcagtgccggccaagaaggaagacgaggcggcggttgccgagttgaaagggaggaagaggggcaagaaggaagccgaggcggtgacggtggccaccgagccgaaagggaggaagagggacaagaaggaa

SEQ ID NO: 7324 - DNA, 293 bp, Zea mays
  misc_feature: Incyte ID No: 700381541H1
gctgtttgcaaagggcaggagattccgttggatccccagcaagtattaacaatacagaattaccaaagaacaatgtttcttctgaagctcatattgatgataatgagttgaggagaaatgatcttgtgaatgatgttgaatcaaattcgatcgatggtaaacatgacaccatgatgaatctttcagttccaaaaatttcatgtctctacaaatgttgttctccatgtttccaatctatttataagatggttcatggtattatttcaaatactctaaggcctaatctgcattgc

SEQ ID NO: 7325 - DNA, 293 bp, Zea mays
  misc_feature: Incyte ID No: 700381542H1
aacaagcattgacaagtgctgaagaaccagatgagcctcctcttagtcccacttcacagaaaattcgccaacaaagacttgtggaagaagctgacttcaagtcgaccaccgagctttttgcaaagaagggcagtgagcaaaagtcactagatacttttattccaaagtccgagagtgactttgcggaatacgcggagttattgcaaacaaactacgcccctatgagaaaagctttcactacatggctctgcttaagaatgtcatgagactttccatgacatcgttgaaaggtg

SEQ ID NO: 7326 - DNA, 292 bp, Zea mays
  misc_feature: Incyte ID No: 700381543H1
  unsure 28, 45, 62, 67, 78, 83, 91, 93, 106, 154: a, t, c, g, or other
aagggactgaactccaagcttctggatntcaggagctacctgganaaagtcgccacaggcangctgnccatcaaccancagancatctacnanctgcaggacgtcntcaacctgctgccagatgtcagcctgcaggagttcgtcaaggcctttncacctgaagaccaatgaccagatggtggtagtgtacttggcctcgctgatccgttccgtggtcgccctgcacaacctcatcaacaacaagattgccaaccgggatgcagagaagaaagaagggcaggagaaagaagag

SEQ ID NO: 7327 - DNA, 290 bp, Zea mays
  misc_feature: Incyte ID No: 700381545H1
  unsure 3-4, 7, 10, 38, 53, 68, 71-72, 74, 76, 85, 93, 106, 112, 116, 144, 149,: a, t, c, g, or other
cgnntgnctncctacaagtctcctcccctccccgtgcntccctcgtgcctcgnttctcttactctgcntcnncntncggcgtctncctccagnctccaacaacccnggaggncgcngtccgcccccgcctccgggagcgatgangatcncgcgactcctgctccgacccaatncccccgcccaggcaacnagcttattgaagcatgtaactggcaccgcaagtagnaaggcaatgcggatagcgngtttgaggctacantnanacattttncgctcagcaccgnctgtnt

SEQ ID NO: 7328 - DNA, 290 bp, Zea mays
  misc_feature: Incyte ID No: 700381546H1
  unsure 3, 22, 122: a, t, c, g, or other
ggnctcttcgaggccgtcctanagctgctgctccctgggaagcgcttcgaagggcccatctcgcctgccgggaacgtgccggtctacaaggcaaatggcttacaagcatatgcagtgacctngataacttaccttggtttgtggtggttcggtatatttaaccctgcaatagtgtatgatcacttgggggagatatactctgctcttgtttttggaagctttgtattctgtatttttctctacataaagggccatgtatttccatcttcatctgactctggatcctctgg

SEQ ID NO: 7329 - DNA, 291 bp, Zea mays
  misc_feature: Incyte ID No: 700381547H1
  unsure 4, 23: a, t, c, g, or other
aganaatcgagataacgagagcnagggttttgattccagtactcacgccgcatcctgtctccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagttaccattgtactgttgtagcttggcagttggttgactgtgtgacaactttgagctatgtcatattacgaaagaaggggtggagacagg

SEQ ID NO: 7330 - DNA, 310 bp, Zea mays
  misc_feature: Incyte ID No: 700381549H1
  unsure 200, 276, 287-288, 293, 296, 301, 306: a, t, c, g, or other
cctaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcnctggcgggggaagcggccggtgtgatatcgtccaccacgattgacgaggcacccaaatccctggatgctccaacgnttttttcctgnnaaaanttnaaagntgggnaatg

SEQ ID NO: 7331 - DNA, 305 bp, Zea mays
  misc_feature: Incyte ID No: 700381550H1
  unsure 175, 201, 235, 243, 266, 269, 271, 274, 287, 293, 304: a, t, c, g, or other
ggcgtttaccgtttcattgctagaccacatgctcctggacgagtcaatctttatttgactttggatgggaaaacaccaatcagtgaggttttgagttttcactatcgtatggtgcctgacagtcaaaacttggctgaggatgagccccaaaagtcaaagcttcagatgcagatgngactagctcgattgtggttcaccacnaacaagaaaaaggtagcacccaagttactgtagnaggaagcnaggtttccatctcctatcagcancgncnganaaggatggtggantcggcnaaatttgttang

SEQ ID NO: 7332 - DNA, 304 bp, Zea mays
  misc_feature: Incyte ID No: 700381551H1
  unsure 234: a, t, c, g, or other
aaggcatccgacgtcgctcccagcccggcgtcggggaaatcgtcagcgagtgcgaaggcgaaggagaaggcgggagagaagagctcgtcgtgccgagccggtggtgccggtgtcgtcgcccattacttggcgatcgctgtctccggcggcctggtgctcttgtggtgaagatcgacgagttcgtcctcaccgtgtgtccgtgtcgaaggagcaagtacggggttcagttaaggncccccgtgtttaatttatatatgggtgttatggattcaattctttggacatatggtaagccattgtgttt

SEQ ID NO: 7333 - DNA, 307 bp, Zea mays
  misc_feature: Incyte ID No: 700381553H1
  unsure 23, 37, 107: a, t, c, g, or other
aactgttcaatcagatgcaagtntgcttgcatctggncaagctacaaagttctgtacatgtggaaaagtatatggatgaggtggagagttcaaaaatttggattgantctggctcatgttgccttgcactctactcaaaattgagtccacatcaagttttgacgcttcaatcaccaattgcccttccaaaggctgttaagaaccccacagaactggatggattgaggaaggcgctattcgagatggtgccgctgttgtacagtaccttgcttggctggataatcagatgcaggagaatatggagctt

SEQ ID NO: 7334 - DNA, 308 bp, Zea mays
  misc_feature: Incyte ID No: 700381554H1
  unsure 19: a, t, c, g, or other
cggagaaggaacgcgagcncagccatccttgttgctgcagggaggaaggagagacaggtggatcgggggcgccagtcaagatgggctcggtgatgtaaggattttcatggtataatgtccaagaatactaaggaattaaggataagtcatcgaaccgggcatggcctgactaccttaccatgcagatgcatgtggctgcaaaaattacaccgttcagttgccaaaggatagttgtgagcagtccaagagcatcatgatatcagtaacaagaagattgtatctttgttggaaatcatttatttggatct

SEQ ID NO: 7335 - DNA, 309 bp, Zea mays
  misc_feature: Incyte ID No: 700381557H1
  unsure 86, 125, 153-154, 194, 216, 223, 276, 288, 301: a, t, c, g, or other
ctcttggggctgaagcagaccaagttccccccaggcaccccagttgtgggggagcctgtattttttttaacaacatccccattccncacctggtcctcccccttcccatgctgccaacttctaancgcaatagtgaactctgtgcttgtctgnncagttctggggataaatggaatgtgtggagatgacccctncctgtgccggctggttcctctnccttttnccctggtcacggctaatcatggaaagcaggaccagtaagggacttcgattaanaaaaaaaaggcntgattaaaaaaanaagggggg

SEQ ID NO: 7336 - DNA, 309 bp, Zea mays
  misc_feature: Incyte ID No: 700381558H1
  unsure 186, 213, 215, 244, 267, 271, 274, 277, 290, 292, 294, 296, 302, 304, 307: a, t, c, g, or other
ggccaggaaagacgaaggaagcaaaaggaaaccaccaggagctgtaaaaatcagcacatggtcactggctcgccttaacgcagaggacgtcacgaaggcagctgttgaggccaagaagagatctaaagtcctccagccgatcacaaggcgggggaatattcttaaacctgacaagagaacagacanaagcagggtgttctacctgtacctgancnattctccggatcccatggcaaggacatcngctatggaccgacgtatttgagngacntgntgntggaaacccccgntngntngccccntnggngg

SEQ ID NO: 7337 - DNA, 308 bp, Zea mays
  misc_feature: Incyte ID No: 700381559H1
  unsure 195, 208, 232, 249, 257, 259, 266, 272, 281, 283, 287, 296, 299, 302: a, t, c, g, or other
tttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctanggcaatatttccnggcgcccagcacctgcacgatcancctaccaggtggcgggntgccatgnantgccggnttgagnttgaggccntngcgntttaaaagnaancanccaacc

SEQ ID NO: 7338 - DNA, 112 bp, Zea mays
  misc_feature: Incyte ID No: 700381563H1
  unsure 2, 7-9, 19: a, t, c, g, or other
gncaccnnngccgcctttngtaccgcggcccctaaacccctttcctcgttcccctccgtctctcagttaggcacaatgatgctagctaataagttggtggtctgtcaagaat

SEQ ID NO: 7339 - DNA, 274 bp, Zea mays
  misc_feature: Incyte ID No: 700381568H1
  unsure 30, 36, 49, 143, 157, 159, 163-165, 173, 197, 202, 208: a, t, c, g, or other
gctttagcgatggtcctgttcatggctggngccgcnctgctcgccgggnctgccggcgccggcgcgcagaagggcgtgtggagcatcatcacccggcccatgttccagagcatgctgagccaccgcggcgacaggggtgccanggcgcttctacacnangacnnntgatcgangccgcaacaagttcccggttcggnacaanggcgangagcagagcgcagcggagtcgcgcttttcggcagagtccagaacacggtgatgggatgttcgatga

SEQ ID NO: 7340 - DNA, 304 bp, Zea mays
  misc_feature: Incyte ID No: 700381571H1
  unsure 39, 152, 192, 196, 219, 227, 241, 243, 252, 286, 296: a, t, c, g, or other
gcgggaccggcgatggagcggctgcagcggatctttggngcctccggcatggggcagccgccgacggactcgccgctgctcgactcctccgagcaggtctacatctcctccctcgcgttctcaagatgctcaagcaacgggaggggccggcntgccccatggaggtcaatgggtctcatgcttcggcgaatncgtngatgaataacaccgtcaaggttngtcgacgnttttcgcatgccgnanaacgggaantggggtcacttcgaagccgtgaccagtttccagncaaacatgtngaaatgtc

SEQ ID NO: 7341 - DNA, 309 bp, Zea mays
  misc_feature: Incyte ID No: 700381573H1
  unsure 146, 186, 197, 200, 224, 230, 254, 258, 262, 271, 280, 285, 287, 302: a, t, c, g, or other
atagcagcagcgcccggaagaagcagcggggtaatgatggcaagaaaaggggtggtggctttacaaaactatgcagtctttccccggcacttcaagagtttgtcggcgcctctgagttagcccaggacagaggtgtccaagaagcnttgggcatatattccgagaaaataattctgcaagaccaanaaccattaggnggnagattttgcctgatgagagtttgnagaagntcttcaatgtccattcccttgatntgcnccanatgaataangtttgaccnagttntntggccattgaattcngggggcc

SEQ ID NO: 7342 - DNA, 111 bp, Zea mays
  misc_feature: Incyte ID No: 700381576H1
  unsure 2, 23, 36, 54, 59, 65, 73, 75, 102: a, t, c, g, or other
cnacgccgcatgatccgtgcacntcgactgctcgcngcgcacgcgcccatcgcnaatcngacacntgccaatncntagcgccgatctctactatctaccggngccttgctt

SEQ ID NO: 7343 - DNA, 303 bp, Zea mays
  misc_feature: Incyte ID No: 700381577H1
  unsure 255, 260, 267, 280, 292, 296: a, t, c, g, or other
agcgcctttccagcatcaatgtcgagaacgtggaggagaaccggcgggctctccgtgagctcctgttctgctgccctggtgccctccagtacatcagcggtgtgatctcttcgaggagaccctctaccagaagaccaaggatggcaagccttttgtcgatgtcctcaaggagggaggcgtctccctggcatcaaggtcgacaagggcaccattgaggttgttggcaccgacaaggagaccaccacccagggccangatgncctcggnaagcgctgcgtangtataggaggcnggtnccttttt

SEQ ID NO: 7344 - DNA, 159 bp, Zea mays
  misc_feature: Incyte ID No: 700381579H1
  unsure 138: a, t, c, g, or other
cggcaaacaaaatggccacatggataagaagagcaacaccgtatcactgcctccatttggcctcgcagcacacaagatacaaggttccctctggaccaaccccatgacaggagaccgcagaaagatggattcctcttnagtgcggcagatcctggctga

SEQ ID NO: 7345 - DNA, 295 bp, Zea mays
  misc_feature: Incyte ID No: 700381583H1
  unsure 162, 275, 281, 283, 294: a, t, c, g, or other
gtgagaggctaaaggatattattctggagaagggcatcacaaaagctgctgttgagcatgtaaaggaaagctttgcttctgctggacagactggcttcagaacaagtgacgaatggacaacaggcttaaaactgccatctattccacccatttctgtcaatnctgaaggggctggctaagggccatctgcctacacagaaatgcattgatgaagaaggcatattaccactgcttccatgctctggaaggggtgcttgtgaaaatgaaatggtgcnagaacngnaaatctttggnt

SEQ ID NO: 7346 - DNA, 296 bp, Zea mays
  misc_feature: Incyte ID No: 700381584H1
  unsure 30, 56, 224, 226-228, 277: a, t, c, g, or other
cagccttaatggacacgaattcgatttcancccatgatgttaataaaaaacacaancgagtttgtgggtaactggaacaaaaacgcggtgcatgtcaacctgtttgagacccctgtggaggctcagtacgtgagattgtaccccacgagctgccacacggcctgcatctgcgctttgagctactgggctgtgagctgaacggatgcgccaatcccctgggcctntnnnataacagcatccctgacaagcagatcacggcctccagcagctacaagantgggggttgcattcttcag

SEQ ID NO: 7347 - DNA, 290 bp, Zea mays
  misc_feature: Incyte ID No: 700381585H1
  unsure 158, 275: a, t, c, g, or other
taagcttttatgaacttctggaggccattgtcgatcagccaccaccttctgcacctgcagatcagttctctccagaattctgctcatttatctcctcttgcatacagaaagatccggctcagaggatgtctgcttcagaactcttgaatcaccctttnttgaagaagttcgaggataaggacttaaacctggggattctgtggagaacctggaacctccaatgaatatacccgaatagcctgtcgttttagtgatgaagccttgtgtgccttcanggttggcctcgaagc

SEQ ID NO: 7348 - DNA, 300 bp, Zea mays
  misc_feature: Incyte ID No: 700381587H1
  unsure 18, 228, 295: a, t, c, g, or other
gaacgtgccccgcctgcnctggtgacggtgagggtgaggccgcacgccatccgccatcctcactgatggttccgtcccgccgccatcggagagtgtagaagtggaagcaagcagataaaccccagcacaagtagttcgtaacgccatccatgggatcctccttatcgaacctcaccgacggccgttgcatcggtgcaccagtttaagatcaaagggttattcggctancaaatccatggcgaggaaggaatcggtcccgtccaagcggctggccgtgggagggtacgattgggangttca

SEQ ID NO: 7349 - DNA, 304 bp, Zea mays
  misc_feature: Incyte ID No: 700381588H1
  unsure 70, 74, 162, 173, 219, 291, 301: a, t, c, g, or other
gggagcatcagtggcgcacaatgagcctcctaatggcagccccagtgtaaatggcttggttgaggagccngaanctctgaagaacagactagaaatgctgcctggtacctttgagccgctgcggaaggaagttgagagtactgttactacgatgtgtaaganaatactgtcgnacctttacaacaaaagtagcatcccagaactggtcgaggtggtctncgtttgctgtaggtgctagagaagcaaccactggccttccactgttggcaaatctagcatctacggtgattntcagaaaggncca

SEQ ID NO: 7350 - DNA, 249 bp, Zea mays
  misc_feature: Incyte ID No: 700381590H1
  unsure 97, 184, 222, 226-227, 234, 239-240, 246: a, t, c, g, or other
gcattctcgaattacgattcccaatccagcaaaccctaccagccttttgcaaactcagagagggacccgatggcacccaaggcggagaagatgcggnggaagaagccgcagaggaggagccgggcccggggagaaggccccgtgggaagaagcgaaggagaagcggtcccgcggaaattcgcgnaagaagcgtgtgaaagaaggcgaagagcagagggtgangtannttctctnagtcnngcgtcnccg

SEQ ID NO: 7351 - DNA, 298 bp, Zea mays
  misc_feature: Incyte ID No: 700381592H1
  unsure 102, 252, 289, 294: a, t, c, g, or other
ggacacaaacaaggttccatctgcctgtctggcttggatttggtgcagcgataaagcacatcatgcagaaggacatcaggaacatccatatactgagagaantgtacaatgagtggccattcttcagggtcacccttgatttgcttgagatggttttcgcgaagggagacccgggaatcgcagctgtgtacgacaattgctagtggtgatgatttgcaatccttcgggcgagcaactgaggaagaactatgnggagacaaaagagctactccttcaggttgctggtcanaaggncgtc

SEQ ID NO: 7352 - DNA, 256 bp, Zea mays
  misc_feature: Incyte ID No: 700381593H1
  unsure 65, 188, 192, 198, 205, 208, 221, 232, 234, 243: a, t, c, g, or other
gctccaggggagacaatgttgaacttgggatcgaaaaccgacaagagactcactgccttccatcntgaaatcgaggagtcatctacaggacgtcgagaactccgagcacaattcgtgtgaaggacagaagaagcgtcatcttctcgatgggcgtctcgacggtgagacatgacaggctggtcagatgncggnaaagcngctgaangantgcgaactcgtangtgcgtgacangnagatcaagnaggagacagcgat

SEQ ID NO: 7353 - DNA, 284 bp, Zea mays
  misc_feature: Incyte ID No: 700381594H1
  unsure 2, 64, 199: a, t, c, g, or other
cngcggcttaaaccctagttctcactcccatcgccgcttcacgctccgccgcagcagatggaanttctggggtctcgaggtcaagcctggttccactgttaagtgtgagcctggatatgggctttggtgctgcaacctttccccaggcttgctccttggggaatcgaaagaagagtgataatgccttgatgtatgtcanaattgatgatcagaaacttgccatggaaccctctctgttgacaagaacccacacatacaatttgatctggtttcgataaagagtt

SEQ ID NO: 7354 - DNA, 220 bp, Zea mays
  misc_feature: Incyte ID No: 700381595H1
  unsure 65, 120, 206, 208, 215: a, t, c, g, or other
tgggacttaaacccacaaacacttagttaacagctaagcaccctaatcaactggcttcaatctanttctcccgccgccgggaaaaaaggcgggagaagcccggcagtttgaagtgttctncgatttgcaattcatatgaaaatcacctcggagtggtaaaaagaggctaaccctgtctttagtttacagtccatgttcactcagcntntttcttntttaa

SEQ ID NO: 7355 - DNA, 97 bp, Zea mays
  misc_feature: Incyte ID No: 700381596H1
gaaaagccaagattgtttgagcttaaagagagaacaaactattatcttacccaacagcttattcagaaatatgatcttgatcctgccgcaaaggctg

SEQ ID NO: 7356 - DNA, 325 bp, Zea mays
  misc_feature: Incyte ID No: 700381601H1
  unsure 87, 116: a, t, c, g, or other
agctgctcatccggaagctgcccttccagaggttggtgagggagatcgcgcaggatttcaaaaccgacctgaggtttcagagcgcancatcggtgcgctgcaggaggctagcgaangtaacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatacttggtttaattgtgactttttttgtaagaaattgtttataatatgtt

SEQ ID NO: 7357 - DNA, 319 bp, Zea mays
  misc_feature: Incyte ID No: 700381603H1
  unsure 2, 10, 12, 17, 20, 44, 53, 59, 83, 97, 103, 204, 210, 222, 250, 263, 274,: a, t, c, g, or other
gnagccatgnangcctngtnctgaccaagctgctcacctcggangagctggcnctgtgncgctccaggctgctggtcttgggntccttcctgcttcncttctntggccttctctgctgtgtcactgctatgtgcttccacccgcgccgggagtcccactggtctagaacccggctctcagggcactggcctagttcccgacttntttctnaggtgtgaatcnacttcttgggccttggctctgagttggnaaaggttttagantaagcgaacanctggannctggnggnanataaaangcttnnntgcncanaaaaana

SEQ ID NO: 7358 - DNA, 318 bp, Zea mays
  misc_feature: Incyte ID No: 700381606H1
  unsure 68, 187-188: a, t, c, g, or other
gggctttgtggccctgggggtgcttctgcagcctcgaaaaagttgcccttacctcctagggtcacctnctgctgccattctgaggaacatctccaaggaacaggagggactttggctagagcctcctgcctccccatcttctctctgcccagaggctcctgggcctggcttggctgtcccctacctnngtccccgggctgcaccccttcctcttctctttctctgtacagtctcagttgcttgctcttgtgcctcctgggcaagggctgaaggaggccactccatctcacctcggggggctgccctcaatgtgggagt

SEQ ID NO: 7359 - DNA, 221 bp, Zea mays
  misc_feature: Incyte ID No: 700381608H1
  unsure 7, 206, 210-211: a, t, c, g, or other
cacaaanataaaattatatttgtcttatgtcattacatatgctgaaggatgccttggtgggtggagacccaatagaaattggcagcagatcaactgtttaaagttttaggagcccagagatgaaaacagtatgttataattgttgcaagagtcttatatttgggagtatagtttattacccaagggacagaatgatgaaaacaganaaannaaaaaaaagg

SEQ ID NO: 7360 - DNA, 317 bp, Zea mays
  misc_feature: Incyte ID No: 700381609H1
atcaactttaagggaagttctaaggacaagttccctttggaaggatcatgtgcaaacctacacacagcacattggtgactttaactaccaacggttagcagactttggtgctgctatctctggtgccaacaagttgctttgccaggaagttcttgaggaattggatgtatacaagcgtttgaagttgacccttgagttagtaaaaaaggagatggagattagtaagctacagcaatccatagcaaaagcaattgaagaaaagattagtggagatcagcgacgtatttattgaacgagcaacttaaggcaatcaagac

SEQ ID NO: 7361 - DNA, 316 bp, Zea mays
  misc_feature: Incyte ID No: 700381611H1
tgaaaaggttctcgtacagccggtatatgaagaataagcttgatacatttgtgaactttccgatccatgacctcaatatgagcaagtatgtgaagcctacatcaagaggtgaccagcaccccgtgtatgaactctatgcagtgataaatcattatggcggtctcggtggtggacactactctgcatatgcgaactagttgaagaggacaattggtatcattttgatgacagtcatgtttcctctgttaatgaggatgagatcaggcgatctgcagcatatgttcttttctaccgacgagttggaggttcaagtaca

SEQ ID NO: 7362 - DNA, 318 bp, Zea mays
  misc_feature: Incyte ID No: 700381612H1
  unsure 68, 82, 85, 94-98, 116, 148, 189, 194, 254, 305: a, t, c, g, or other
gccgtgaactgtgcatagtgctgggatggaggggagtgttgggcatgtgatcacgcctggctaataangctttagtgtattnatntatttattnnnnntatttgtttttcattcancccattaatcatttccccataactcaatggcntaaaactggcctgacttgggggaacgatgtgactgtatttnatgtngctgtagatcccaagatgactggggtgggaggtcttgctagaatgggaagggtcataganagggccttgacatcagttcctttgtgtgtactcactgaagcctgcgttggnccagagcggaggg

SEQ ID NO: 7363 - DNA, 321 bp, Zea mays
  misc_feature: Incyte ID No: 700381613H1
  unsure 6, 8, 15, 27, 30, 41, 82, 85, 88, 90-91, 93, 96, 98, 103, 107, 110, 112,: a, t, c, g, or other
ctcgcntnggatcgnttggtttcgtanctngtgagggactnagggtctcggagtggattgatttgggattctgtcacgaagnttngcngnngnggncnatggngacngcngngaannngatgcaantncanagctgcggtggcatgggangccggcaagccactgtcgatcgaggaggtggaggtagcgcctccgcntgccatggnntgtgcncgtcaagatcctcttcacctcgctctgccacaccgacgtctacttctgggaggccaaggcgcagactcccgtgttcnctcggatctttggccagaggctaggagntat

SEQ ID NO: 7364 - DNA, 322 bp, Zea mays
  misc_feature: Incyte ID No: 700381615H1
  unsure 305: a, t, c, g, or other
gtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagacagtcccacccanctttctggctcatctga

SEQ ID NO: 7365 - DNA, 146 bp, Zea mays
  misc_feature: Incyte ID No: 700381616H1
  unsure 2, 39, 69, 80: a, t, c, g, or other
cntcctcatgcatttccagcctttcaaccctccccgacnctgcggctcccctcagcccccttgcaagtncatggcctgtncctgcccagacccctgctccactggcccttcgaccagtcctcccttctgttctctctttccccgtc

SEQ ID NO: 7366 - DNA, 312 bp, Zea mays
  misc_feature: Incyte ID No: 700381617H1
  unsure 252: a, t, c, g, or other
tcccaccgtcgcaagccagccacctccctgagaggcctgaccgtgatttcggcgtggcatccaaaggcggtcaagattcgagaggccggaggaaccaagcgtagggcctccgaccccacgtcgtcgtccgcgcgcgccgcccgccgtcgcagggagatgggggccgattactacaaggtcctcggcgtcgaccgcggcgccagcgacgacgacctcaagaaggcctatcggaagctcgccatgcgatggcancccgacaagaactccaccaataagaaggaggcagaaaccaattcaaggagatctctgtgg

SEQ ID NO: 7367 - DNA, 319 bp, Zea mays
  misc_feature: Incyte ID No: 700381619H1
  unsure 25, 37, 49-50, 53-54, 81, 90, 138, 145, 169, 202-203, 206, 210, 221, 234,: a, t, c, g, or other
agcctagcatgtctggcccaaagangcctcatgatcntgtccctttganncgnnagtggatcagattggcatgcttgcctngtacaacanagttgggttcaagggttttgcagtgccaaaggagcagcaggataaggntgtcaantttgactttcatgggcagccagcngaaatgaagcatggtagtgttgttatagcagcnntanctanctgcacaaacncctcaaatcctantgttatgcttggtgctggtcttgtagctaaggaagcnagcgagttgggtcttgaggttaaaccatnggtganagacnatncttgc

SEQ ID NO: 7368 - DNA, 315 bp, Zea mays
  misc_feature: Incyte ID No: 700381620H1
  unsure 10, 39, 114, 137, 165, 176, 188, 194, 233, 239, 247, 255-259, 261-262, 282,: a, t, c, g, or other
gatcgctttnaggtacaaggtctgcagcctaatggtgangagatgaccctcaaacagttcctcgactattttaatacagagcacaaattagagatcaccatgctgtcccagggngtgtccatcactctattccttcntcattccagctgccaagctacaatgaanggttggatcanccgatgacaganattgtnagccgtatgtctaagcgaaactgggccgccacgtgcagncgctgntgcttganttgtgctnnnnntnngagagcggcgaggatgtcgntgttccctatatccnatacacnagncgntgaac

SEQ ID NO: 7369 - DNA, 312 bp, Zea mays
  misc_feature: Incyte ID No: 700381623H1
  unsure 29, 78, 95, 135, 139, 191, 194, 210, 217, 241, 284, 304, 311: a, t, c, g, or other
caagcgccaagctgctgtgctgtgccgtnggtggcggcggcgggagtggaagtggaaccgcagccggtggctgtgatngacgcgcacagcagctngatttggtcatgcgtcaccagagcatggccaccgtctgcnagancgaggacgcgctggggtcgtcggagtcggatcccgcgaggccggcgcgcccncgnggcaagaggagccgcnccgccgnggtgcacaacctctccgagaatangaggaggagcaggatcaacgagaagatgaaggcgttgcagacnctcatactcaactcgagcantacggana

SEQ ID NO: 7370 - DNA, 308 bp, Zea mays
  misc_feature: Incyte ID No: 700381624H1
  unsure 153: a, t, c, g, or other
gcgggagtgatgtcgaccactttatgagctttcccccctgctattttggggtttatccctttagattcgctctagttatggcggatcttgacatggagcattaggaatttctttcgtcgaaggcggcgcggcgccaggtcgtggcatgcgcancatttgccggtcgtggcgcgaggtcaccaaggaggtggtgaagacgctcgaggagtgtggcaggattaccttccccatatcccttaagcagccggggcctcgtgaaatgccggtccagtgttttgtgaggagagagagggcaacatccacatatt

SEQ ID NO: 7371 - DNA, 280 bp, Zea mays
  misc_feature: Incyte ID No: 700381625H1
  unsure 7, 10, 13-15, 22, 24, 31, 37, 45, 48, 51, 57, 65, 82, 90, 101, 108, 113,: a, t, c, g, or other
atattgnacnccnnntcttccntntagcacnacattntgaaattnttnggntattgnaatgatgntgatcgggagttgaganaatgcctnaagaatgagtncgtaganaacangnccaagagcagggagcatggcattgcaatgcganagaaacttttnaatcctccagaggaatncgaaaannaaatngtatnntcactcgatgccttggctgagagaagacctaaagacnctgggttgatacctgaaagantcctgncttatntggtctccatantcc

SEQ ID NO: 7372 - DNA, 312 bp, Zea mays
  misc_feature: Incyte ID No: 700381626H1
ggctcatggtggtagtaaattgtgcatcttttctgaagaatacattctcggtaactaccattaccgtgttcaacattttgatgaatgaagctgtgactcaggatgtaagagccgcagccaatgggatagctgtaacactaatgtccatctctaaagcggttgctccagctgttgcaggaatcatattttcgtgggcccagaggcgtcaaacagctgcatttcttccaggcgaccacttggtgttcttcatactgaacatcttcacgttcatcggtttcgtcttcaccttcagaccgtttttcgttcgaggca

SEQ ID NO: 7373 - DNA, 313 bp, Zea mays
  misc_feature: Incyte ID No: 700381627H1
  unsure 70: a, t, c, g, or other
aaggaataactttgcagtgggctacaggactggggacttccagctacacactaatgtcaatgatgggacncaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaat

SEQ ID NO: 7374 - DNA, 376 bp, Zea mays
  misc_feature: Incyte ID No: 700381628H1
  unsure 141, 161, 229, 261, 287, 313, 337, 347, 362: a, t, c, g, or other
tcgcgtggtacgctggcaagcgcatggcgtacatctacaaggctaagaccaagagcagcgagacccgctacaggtgcatctggggcaaggtccacccgcccgcacggcaactcgggcgtcgtccgcggccaagttcaagtnccaacctcccgcctggagtnccatggggcgcaaggttcagagtgtttcatgtaaccccgaggcagccattctaaaggttttttggttnggaagtaaaagggtgggaactctaaaatgggnccatggctttaagtttctttcttctnctggaggctttaaaaaatggcccatngttggtttgggccaaactttaagnattttgtttncaatggttaacttgnaaacccttggtttg

SEQ ID NO: 7375 - DNA, 315 bp, Zea mays
  misc_feature: Incyte ID No: 700381630H1
attgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcag

SEQ ID NO: 7376 - DNA, 319 bp, Zea mays
  misc_feature: Incyte ID No: 700381631H1
gctgcaacggcctgcgagctccccatccgacccgtcttgaaacacggaccaaggagtctgacatgcgtgcgagtcgacgggttcagaaacctgagatgcgcaaggaagctgacgtcgtccaggatatgttcagcaattcccaatggtcaacacaagaaggcgtaggactaagcacatgcaggaagatcctcaaattgatgggtggcgaggtccaatacatcagagagtcagagcggagtttcttcctcatcgtcctcgagcagccccaacctcgtccagcagctggtagagaaatcgtctgatatgttaagatccgtgc

SEQ ID NO: 7377 - DNA, 312 bp, Zea mays
  misc_feature: Incyte ID No: 700381633H1
gcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagaggctgctgcagtctgggaacagcttcc

SEQ ID NO: 7378 - DNA, 311 bp, Zea mays
  misc_feature: Incyte ID No: 700381634H1
  unsure 48, 84, 90, 260, 283, 286-287, 289, 292-294: a, t, c, g, or other
gttggcagaacccattatacggttgcttcctgttgcgcttggcctttnatatcttggaaaacaggatagtgtggaggctaccgnagagcncctctaaaacatttgatgagaagatagggaagtactgtgatgtaacacttatgtcactggcatatgccgggacaggaaatgtgcttaaggttcagaaacttcttggcatttgctcacagcatcttgagaaaggtgaaacacaccaagggccagctgtcctagggattgcncttattgctatggctgaagaatnagnngnctnnntgggtgtacgttcactt

SEQ ID NO: 7379 - DNA, 309 bp, Zea mays
  misc_feature: Incyte ID No: 700381635H1
  unsure 32: a, t, c, g, or other
gggaagaagtttgaggacaaatttgtggatancttgcttaaatatggatacaaaggtcaatatatgtcagagaattggctgaagcagccattgtttatacaatcctttgctcccacctccattgtacatgtatcagattttattgactctcccaaggtatttttgattgatgatatcagtgtgagaacacaagacacgaaccagtcatactgggaaattacttcagatgactaccttgcatacattagtaaatatgtcgttggccttggtccatggaaggacactattgttccagcttcaggaaactac

SEQ ID NO: 7380 - DNA, 303 bp, Zea mays
  misc_feature: Incyte ID No: 700381637H1
  unsure 7-8, 42, 44, 68, 87, 108-109, 117, 119, 123-125, 132, 134, 139, 143,: a, t, c, g, or other
ggaagtnntaccacatgtaacagattcctttatatgtagtgngnatcactatttgtagaaactgtcangtcaaaatatttaactgantgttgacatgtattgtctttnntccttgtntntgtnnnttggggntntctgntttnagatatatacnnctatgtatatccagttnactgagngattttgactctctnaatanaactgcattaagnntntgattnngtagaaattagcttttgtctnagcaactagtggtgatactctgcaaatnttgtaatgantcttactnnactgtnnagaggg

SEQ ID NO: 7381 - DNA, 305 bp, Zea mays
  misc_feature: Incyte ID No: 700381641H1
cgaaggtctcagctgtagacaagtcaccgagcgacaccgcgcttggccggaaccaggtcgccgatcatgagccaggggcgtcgttggagttggagaagccaccggtgtcccgagagtcagctgcgccggcaaagcggctggacgagcagctgcagtctttctcgttccttgagagcgtcgtccctggggttgcttttcatgccggggctaacacgggcggcgaacggggtccaggacctcgccgcagctgaccaggtcgctgtcccagagggctggtgtgggcaaggcaaaagccggcgctgcca

SEQ ID NO: 7382 - DNA, 306 bp, Zea mays
  misc_feature: Incyte ID No: 700381642H1
  unsure 96: a, t, c, g, or other
ctggcacctcaggaatggaaagattttattgtccctttccaaactgttcagtgctgttagaccttagtcagcacttctctagggcaagttcatcangccagtcagatctcagttgtgtcgagtgcccagaatgccatagagatatatgtatcaactgtggagtgccgtggcacatcatgatgggctgtgatgagtaccagagcttgcccgctgaggaaagagatgctggagacctatctttgcatcggcttgcacagaacaataggtggaggcgttgccagagatgtcgacgtatgattgaactga

SEQ ID NO: 7383 - DNA, 310 bp, Zea mays
  misc_feature: Incyte ID No: 700381643H1
  unsure 131, 164, 171, 175, 179, 182, 189, 192, 197, 204, 209, 211, 215, 219, 221,: a, t, c, g, or other
agaagcgtaaccctaagtctcggaccccaaccctcgaggaaggcgaccggagatggcggcgtcgtcggcggtggagaagcttcaaggtcctctgggactcgcaggtcaacgacgaggagcagtgggcgctnaattataaagcttgcttgaaaggttgctggtcnggttgcnggantcantcntcctgantgnggaanttcggtnatctnanggcnattnantaggctnannanngtggttnacttggatccnatnantgtggtttnnangttccattaattccngcaatgatatgaaancnattngctcc

SEQ ID NO: 7384 - DNA, 307 bp, Zea mays
  misc_feature: Incyte ID No: 700381644H1
  unsure 127, 169: a, t, c, g, or other
agcgcacagctctcctcatcggcgcacccgagctcgccctctccttcctcatcgaggcccgagtcctgctctgatggcgaccgacgtggctgagactcccgcgccgttggtggatgcggcccctgangcgcccgcggacaccccggcggcgcctgctgttgacgcgaancggccaaggccaagaaggccacagcgccgaagaagcgcgccagcccgacccatccgccgtacgccgagatggtctcggaggcgatcgcgtcgctcaaggagaggacggggtccagcagctttgctattgccaagttct

SEQ ID NO: 7385 - DNA, 299 bp, Zea mays
  misc_feature: Incyte ID No: 700381645H1
  unsure 55, 96-97, 100-101: a, t, c, g, or other
cttgaatgtacaacccaccccactgtcgggaaggcctccgtcctcggcccctgcntcttgctgctgtcctgtccccgagcccctgcaggtcccccnncgnncccccactcaagagttaagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatt

SEQ ID NO: 7386 - DNA, 226 bp, Zea mays
  misc_feature: Incyte ID No: 700381648H1
  unsure 2, 35, 38, 57, 66, 70, 94, 106, 109, 121, 123-124, 127, 137, 149, 174,: a, t, c, g, or other
angccacctgctgcgccgatcacctgcactgctgnccncaagacactgtgtgtgacntgatccagngtangtgcctctccaaggagaacgctancacggacctccncantaagctgcgtgngnncanagtgggggangtgaatgtggantgaagtgtaagctccccagtggctnannctgcttgcggcngaaatnngtggcctgggntgntgcnntntgacccngg

SEQ ID NO: 7387 - DNA, 310 bp, Zea mays
  misc_feature: Incyte ID No: 700381650H1
  unsure 58, 116, 119, 123, 150, 158, 303: a, t, c, g, or other
ccaaattctccttagagacagtgattaatagaaggaatgagtggaagattagtatacncacaaggctattcaggagtgggggtaaaatgttaatgcggtgacctttaaatcttcanttntctntatttccctgaatgctaattaaagganatgttcancaccaggaggaatttgcatccaagtccgtctccctggctaagtggtattttgagaattccgaagcttagtctcagagaagagctgacctgaacttgtccgaggctcccactgcattgtagcttttctctggagaacaaaaactgncattgtc

SEQ ID NO: 7388 - DNA, 301 bp, Zea mays
  misc_feature: Incyte ID No: 700381652H1
  unsure 115: a, t, c, g, or other
attgagcgtgctgctatcaatgctcctgtacagggcagtgcagctgatgttgctatgtgtgcaatgcttgagatagacaggaatactcgtcttaaggagcttggttggacgctantcttgcaggtgcatgatgaagtgatactggaagggccttcagagtctgcggagtggccaagtccatagttgttgagtgcatgtctaagcccttctatggcaccaatatcctgaaggtcgaccttgctgttgatgccaagtgtgcacagaattggtatgcggccaaatagacctgttaagtgtcccc

SEQ ID NO: 7389 - DNA, 300 bp, Zea mays
  misc_feature: Incyte ID No: 700381653H1
  unsure 93-115: a, t, c, g, or other
gccgtggacgacgactgcaagcgccggttcctggagctcaaggccaagaggacgcaccgcttcatcatctacaggatcgacgagaagaagaannnnnnnnnnnnnnnnnnnnnnngcaagcccgtgctcggctacgacgacttcgccgccagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggag

SEQ ID NO: 7390 - DNA, 68 bp, Zea mays
  misc_feature: Incyte ID No: 700381654H1
  unsure 5, 9-10, 49-51, 53, 61: a, t, c, g, or other
ctcgngccnngaaaaagtagagaaaactaatgaaacatagggttccttnnnantccatcantaacatt

SEQ ID NO: 7391 - DNA, 218 bp, Zea mays
  misc_feature: Incyte ID No: 700381657H1
  unsure 2, 7, 9, 20, 22, 39, 41, 52, 74, 78, 90, 93, 98, 100, 115, 121, 124, 131,: a, t, c, g, or other
cngaccntngactattctcnanaagccacaaagacattngnacactataccnattattcggcgcatgagctggnatcntaggcacagctntancgccncnttattcgagccgagntgggcnagncaggcanccttctangtaacgancacatctacaanggtatcgtcanagcccatgcattngtaataatctncttcatagtaatanccntcataat

SEQ ID NO: 7392 - DNA, 295 bp, Zea mays
  misc_feature: Incyte ID No: 700381658H1
ggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccggggatctgaagctctgaaccaaaaccggcaatc

SEQ ID NO: 7393 - DNA, 295 bp, Zea mays
  misc_feature: Incyte ID No: 700381659H1
  unsure 29, 38, 199, 201: a, t, c, g, or other
caagaggcgacggaatgacggagcggcangtggcggantgggtcccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccngnctcatggggatgctatagcttgtgtttgtgctgatgggacactgtctttgtgggaggaggtgctgctgatgatcaacttccaacctggagaaat

SEQ ID NO: 7394 - DNA, 289 bp, Zea mays
  misc_feature: Incyte ID No: 700381660H1
  unsure 5, 50: a, t, c, g, or other
gatcngcaaggccaatcccgagcagtggtgcgaaacctcgagcgctcgcnccactgaccataacaaagaggaagccgcggtagcactggtagcggcagagtaagggggagatgtcgtcggcgttcagcggcgatgagaccgcccctttcttcggcttccttggcgcctccgctgcgctcgtcttctcatgcatgggggcggcgtacgggacagccaagagtggcgtcggcgtggcgtccatgggtgtcatgcgcccagagcttcgtcatgaagtccatcgtgcccgtgg

SEQ ID NO: 7395 - DNA, 299 bp, Zea mays
  misc_feature: Incyte ID No: 700381661H1
gagacttcacaaagagtatagctgtatctctatagctctatagcgccgatagatccatcctctctctttccactcctagctagctaacatatccacacatggccagcagttccaaggtcgtgtgcgcatgcattctcatcgttctcgtcatctcaagccacgccgacgcgaggcggctggtggcggcgacgtgcaacggaggaacggaaggaggagcatgcaagggtggcatcttcgtccaaggatatgcaggcctcagtgcaaggcagaaaatggcggccagtgcaagaagcactgag

SEQ ID NO: 7396 - DNA, 306 bp, Zea mays
  misc_feature: Incyte ID No: 700381663H1
  unsure 9, 26, 44: a, t, c, g, or other
gctgagggnagatggagaaggcgaancccaaaactggaccaacncctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttctcgtgctttga

SEQ ID NO: 7397 - DNA, 306 bp, Zea mays
  misc_feature: Incyte ID No: 700381664H1
  unsure 214, 224, 228, 251, 264, 287-288: a, t, c, g, or other
gtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagancccgaggagnctcncctgtcccctcgggcagatctgntgtgtctctcttnccactggcaagctcagctctgtnnccctcaccctggctcctt

SEQ ID NO: 7398 - DNA, 302 bp, Zea mays
  misc_feature: Incyte ID No: 700381665H1
cgtttaaggatcttgtgggaagtgcatattatgttgctcctgaggtactgaaacggaaatatggggcagaggctgacatatggagtgctggggtcattctttacatccttctgtctggtgttcctcctttttgggcagagaatgaggatggcatatttgatgctgtcttgcgcggtcacatcgatttctcttctgacccttggccttcaatatccaatggtgcaaaggatttggttaagaagatgctgcgacaagacccaaaagaacgcctgactgctgctgaaattttgaaccacccatgg

SEQ ID NO: 7399 - DNA, 190 bp, Zea mays
  misc_feature: Incyte ID No: 700381667H1
  unsure 15, 20, 24-25, 27, 31, 65, 69, 78, 87, 100, 113, 123-124, 133, 159, 165,: a, t, c, g, or other
gtgagaccgtctcangaatnaatnnantaantaaataaattgccaggccagagaaaatgcttaantatnacaactggnaaatcatangagttatggttgntgtggctcccagncagttgagtnngtaatgggnctggtggactcaggtgggggaacgangaaganataaggttcnattntgagaactgaa

SEQ ID NO: 7400 - DNA, 292 bp, Zea mays
  misc_feature: Incyte ID No: 700381668H1
aaggattctagtggtcaatggttttgttgtaacgattctcatgtctccctatcaagttctcagaatgttttgtctgagaaggtctacatcctattttatatactgaattcaaaaactcaaaagtctagtacaaatggttactcttttactgcagctaaacctttcagcaccaatgtaattgacatatcaagcacctcacctagtgagacctcgaagatacctttggtaaaacagaatgacctacgtcttgccaaaggtaatgtactgatgccctgaggaatggcaagactgc

SEQ ID NO: 7401 - DNA, 291 bp, Zea mays
  misc_feature: Incyte ID No: 700381669H1
  unsure 92: a, t, c, g, or other
tattgatgtactatttcatctcatgtcacaaatttggcataaggaaatgggtattggtggctactagtttgtttccacgtattatacatgtnccaatggaacagttgataatagttttgcatgaactattggcgttggctatctaaaaggacagaaaggcagacatgagcaacaaatcctgctccatgggctgaaactgggattcgtgatggcagaaagtgctactgctgctctcagctgtagtggtgtggtactgggatccatgccaataagtgtgtttttaggatgagc

SEQ ID NO: 7402 - DNA, 212 bp, Zea mays
  misc_feature: Incyte ID No: 700381670H1
aattgaagttgagggaagagatgattggagtgttcagattgctgaactgagttccattttgtggcgctgatgatcgttcagctcatatattatttagcaattgtagctaaaacattaattcccggtcgatttgttgtatgtgaagcttcctcgcttcctcgctcacatcattgatgatgataatattcatagtaaccagattttcctttttc

SEQ ID NO: 7403 - DNA, 290 bp, Zea mays
  misc_feature: Incyte ID No: 700381671H1
ggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggtgagcctcctggcctgcctgcccgcccaccctgggagtcccagtggtgaggctcagagaacttctaaggggaaagaacagctggagtttctgt

SEQ ID NO: 7404 - DNA, 288 bp, Zea mays
  misc_feature: Incyte ID No: 700381672H1
  unsure 101-103: a, t, c, g, or other
aacccaccctccatggtcttcaagcagatggagcaggtggctcagttcctgaaggcggctgaggactatggggtcatcaagactgacatgttccagactgnnnaactctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggcttc

SEQ ID NO: 7405 - DNA, 290 bp, Zea mays
  misc_feature: Incyte ID No: 700381676H1
gttgttgttgaaaagcacggaatggtggctgctggagccctcgtacgacagaatactaggatcccttgtggagaggtatggggagggaaccctgccaaatttctgaggaagctcacagatgacgagatcagtttcattgcggaatcagctgccaactattccaatctgtccaaggtccatgctgctgagaatgccaaacctcttgaaaagatcgagtttgagaaggtgttgggcaagaagtttgctcaccaggatgagtatgattcctcgattggcgtcgctgaaggggc

SEQ ID NO: 7406 - DNA, 182 bp, Zea mays
  misc_feature: Incyte ID No: 700381678H1
caactgtgtccttgaaatggcagtttgatcgggtcctagataggtttctatcttacgataaggacaatgctaagacagttggttaccttaatctttatggacagatgctatgtgttgcttctgtggcacttttgtttaagctaagttttgcggagacaagatacttatatatgttccggatg

SEQ ID NO: 7407 - DNA, 295 bp, Zea mays
  misc_feature: Incyte ID No: 700381679H1
  unsure 4, 282: a, t, c, g, or other
aaanattttagctttcaagatgctgatgtccttaaaccagacatacttgctcctggcaatctcacatgggctgcatgggcgcctaatggaacagatgaatcaaattatgctggtgaaggatttgcaatggtttctggaactagcatggctgcgccgcatattgctggcattgcagcactgataaagcagaagaacccaaagtggagcccctcagcaataaaatctgccctgatgacaacggccaatacactggacaaagggagccatcctcttagagcgcanagtacaccgcatc

SEQ ID NO: 7408 - DNA, 292 bp, Zea mays
  misc_feature: Incyte ID No: 700381680H1
  unsure 38: a, t, c, g, or other
caattcgcttcgaacagggcagaggtgagacttgaganaaggaagaaggccatgtcgtcggcggcgcagcagcagcagaaggcggcggcagcggagcaggaggaggtggagcacgggccattccccatcgagcagctccaggcttctggaatagctgcattggatgtgaagaagctgaaagattctggtctccacactgtggaggctgtggcttacactccaaggaaagatcttctgcagatcaaagggataagtgaagctaaagctgacaagataattgaagcagcatcca

SEQ ID NO: 7409 - DNA, 293 bp, Zea mays
  misc_feature: Incyte ID No: 700381681H1
  unsure 142-144, 170, 182, 191: a, t, c, g, or other
ccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaannngcttgatgagtaccttctcactcgcngctacatcactngctaccaancttccaaggatgacttggctgtctacacttcgttttcggctgctccctcgtccaagtatatcaacgtagcaaggtggtttaaccacattgatgcgctcgtga

SEQ ID NO: 7410 - DNA, 289 bp, Zea mays
  misc_feature: Incyte ID No: 700381682H1
  unsure 27, 38, 40, 84, 195, 211, 216, 241, 266, 282: a, t, c, g, or other
ccacgcatggcagaccaggctgcagtngcaaccctgangngccccccgccgagtcccagggccctgcaggggcctcgacagganccgggcctatctctaaagcagagggaatggctgggcatgaacttcgacattccaaaaccccaagccaggaaaaagggcagggcctggtcctagggatgcttactggcagcnagagcagtgcccagtnagggngggaggtagcaccaggctctgtgancctcacccaagtgggggggtggtcngtggaagctggggatncttcact

SEQ ID NO: 7411 - DNA, 262 bp, Zea mays
  misc_feature: Incyte ID No: 700381683H1
  unsure 8-9, 81: a, t, c, g, or other
gtaatggnngccgcgcctaccaccatcaccgtccaggtcaagttcgccgggcggacgatccccgtggaggtcccggcagcngcttccggcgcggagtgaagcgcctcctccagccgctgaccaatgtcctcccgcgcggccagaggctcatctgcaaaggcaaagtgctccaggatgccgcaagcctgagctcgatgcaagtagtgggcggatccaaggtgatgctcatcgcgtcgcaggggctccatcagggggatggtcc

SEQ ID NO: 7412 - DNA, 286 bp, Zea mays
  misc_feature: Incyte ID No: 700381684H1
atgaaccagatgtacctcaaggggagcaatgccaattccaatgtcaatgcgttcaagatgaatgttggagtcaacaagtactccaatagtccaaacgggaaagacgccaatgggaaaaacaatggcggcagtggcggcaacaacaacaatgggagcgccaacggcacttctgtggctgacaagcgcttcaagacattgccgacgagtgagatgctaccgaggaatgaagtccttggtggatacatctttgtctgcaacaacgataccatgcaggaggatctcaaga

SEQ ID NO: 7413 - DNA, 284 bp, Zea mays
  misc_feature: Incyte ID No: 700381685H1
  unsure 253: a, t, c, g, or other
atcgactggagcagggtggtgtcgcagtacgtgcgcgacgagacctacgagggcatcgaggccccgcactgggccgacctctccgaccccaacgccggccgcgccgccgtcgacgacgaggcctggttttgccgccccgattgccagcatccgaagacggccgaggatttcttcaagctgagccccagccccaagggcaagctgctgcgatcggtttccgccatgctgccgttcgccgaaagggacgccaacnccaccagcctcagggacggcagtagcaatct

SEQ ID NO: 7414 - DNA, 284 bp, Zea mays
  misc_feature: Incyte ID No: 700381686H1
cgaaccttggcgtctgccctaccaaccgcagcagcgacactagaatggccgcggcgccgtcatccctcgcgtcctcccacctcttccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgt

SEQ ID NO: 7415 - DNA, 285 bp, Zea mays
  misc_feature: Incyte ID No: 700381687H1
  unsure 4, 43, 60-61, 72, 76, 86, 106, 109, 114, 116-120, 140, 148, 155, 194, 201,: a, t, c, g, or other
atancttctggatcttatgtagtggaagttgtatctccagctntacagatttgatcccgnncgagtggatancacntacggaaagnaaaatgagagcaagatatgnganttacntnnnnncatcagaggttgtcagactnccctatcntctccanatgaaatcttcaggtccaccttcttactttattaaaagngaatcgnggggctngacagacttncnaatgaannccgatggtnatnatgagggntcttcctttantngatatntgngcttctgccgaaaag

SEQ ID NO: 7416 - DNA, 282 bp, Zea mays
  misc_feature: Incyte ID No: 700381688H1
  unsure 219-220, 222, 227: a, t, c, g, or other
gcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggnngnctgcncccgctaaccggctttttgcccaaatgggccattatcgaagaattcacaaaaaac

SEQ ID NO: 7417 - DNA, 280 bp, Zea mays
  misc_feature: Incyte ID No: 700381689H1
  unsure 31, 87, 186, 193: a, t, c, g, or other
atcccgcgcccttccaccctcccgccgaaancccagcccggatggcgtctctagaaggcgaccggtggtcggagatcgtggccagcngccgtgcccggccgccccgcgttggcgtcgtgtacggtcgtcgcctggtcgaggaatcgtccggcagggccaacatggaaacgagagccagcttcagtngcctgcngcgcccgagcttcgtgccgcgcaaggaaccagctggaaccggtcgctttccatcagagggagagagagtatcttcgtcgcacctggt

SEQ ID NO: 7418 - DNA, 281 bp, Zea mays
  misc_feature: Incyte ID No: 700381691H1
ataccagttagtaaagcatttatgatgtacattgttatacatagagctttacatcacaaaaattatcagtttccctcagttacgatatgcatttagtatttatcgtattttgaaaattaataacctattatactatgataggcttgacttcatgtttatctaaataacttagtgcgatgatgcttgaaaacttatcttccattttgccagatcaatgaataaaaggattattcatatcaatgtccatgcaccttctcagaaaatccttttgtgatgttggt

SEQ ID NO: 7419 - DNA, 281 bp, Zea mays
  misc_feature: Incyte ID No: 700381692H1
  unsure 13, 23, 26, 36, 42, 54, 56, 139, 152, 170, 178, 187, 229, 235-236, 250,: a, t, c, g, or other
acctatgagactntggatgccanagngattcaaatngttctngaggggaaaaantnggaagtgagatgataactctcttgatatggatgcttgctggttttattgcaagaatataagtagcattgcagtagtctacttntacaacgctttcncctcattcttgatgtggngtaattgnagggtgtgnaatgctttgtcaatcatttgtcacatttatccagtttgggtnattctnnttatgacacctatngcaaattagcatcccanggcaaatatntttt

SEQ ID NO: 7420 - DNA, 286 bp, Zea mays
  misc_feature: Incyte ID No: 700381693H1
  unsure 7, 11, 15, 20-21, 23, 118-119, 176-177, 216, 223, 226, 229, 251, 259, 267,: a, t, c, g, or other
acgaacntatnactnagctnncntgccttacagccacattggctgccgtgaccagattatctttatggtgggccgtggctatctgtccccggacctgagcaaaatctccagcaactgnnccaaggccatgcggcgcctgctgtctgactgcctcaagttccagcgggaggagcggnnccctcttcccccagatcctggccacaattgagctgctgnaacggtnacnccncaagattgagcggagtgcctcngaaccctncttgcagngaaggcaggncgattagtt

SEQ ID NO: 7421 - DNA, 290 bp, Zea mays
  misc_feature: Incyte ID No: 700381694H1
  unsure 5, 7, 9, 12, 15, 30, 65, 74, 76, 78-79, 92, 95, 118-119, 122, 129, 156,: a, t, c, g, or other
tcganancnggnctngaacgtgcactcagnagctgaacctgtctgacccggtcacgttcttggancctcagaantncnntgctcttgtcggnatnggggtgggaactcacgtggggannggnggctacngaaaatgtaaggattctggaatacatnttcnatgggactttccttccctcncctggcntnnctcttngncctgactccctaacctttcggcgaatggggcagcancactgangtntctnggcgngccagtgcggntgccaggntcctggtactaatgcctg

SEQ ID NO: 7422 - DNA, 183 bp, Zea mays
  misc_feature: Incyte ID No: 700381696H1
  unsure 4, 6, 16, 19, 29, 66, 88, 145, 151, 156-157, 160, 175: a, t, c, g, or other
acananagagattggnganccatgatganatccggccttctctcgctatgtttccacctagccctngccatcacactggctgcaagtnttcctggccttggtcgtagtagggtaatcgacatcgaaccgcaactcaaaccgacgntgcaantaganncanagcatggtgtatctntaccagac

SEQ ID NO: 7423 - DNA, 296 bp, Zea mays
  misc_feature: Incyte ID No: 700381702H1
  unsure 126, 208-209, 229, 258, 271: a, t, c, g, or other
cgagaaagcacataccaaggccaccacacaccacctgtccaaaaaggccttcgatacgggataatcctatttattacctcagaagtttttttcttcgcaggatttttctgagccttttaccactcnagcctagcccctaccccccaattaggagggcactggcccccaacaggcatcaccccgctaaatccctagaagtccactcctnnaaaacatccgtattactcgncatcaggagtatcatcacctgagctcacnatagtctattagnaaacaaccgaaaccaattattcgag

SEQ ID NO: 7424 - DNA, 176 bp, Zea mays
  misc_feature: Incyte ID No: 700381703H1
gattcgttgaagaggaggtgctctgtagcagaaactgagctccgggtggctggttctcagtggttgtctcatgtctctttttctgtcttaggtggtttcattaaatgcagcacttggttagcagatggttaattttttttttaacaacataacttgtggcctctttctacaccggg

SEQ ID NO: 7425 - DNA, 296 bp, Zea mays
  misc_feature: Incyte ID No: 700381704H1
gaatattcagttagcagattgaatgcagatgtcctggagcaatttataactgagaactacactgcttccagaattgttctagctgcatcaggtgttgatcatgatgaattggtatctattgccgaaccccttctgtctgacattcccagtgtatctggaacaacaaggccaaaatcaacctacattggtggagaatacagaagaagtgcagattcatcgaacacagacgttgcattggcattcgaggtcccaagtggttggctcaaagaaaaagattgtgtcactgtatcagttct

SEQ ID NO: 7426 - DNA, 293 bp, Zea mays
  misc_feature: Incyte ID No: 700381706H1
  unsure 9, 123, 185-186, 189, 198-199, 246, 258-259, 273: a, t, c, g, or other
aagaatgtntgtgatatcttctctcgcttaacatactttgatttcaccattgcatttcagcattttaaagaatagtgtatcagtatagaaggaggagcaaagctctttaagagtaatgatganaccaaaaggtcaaaaagtagaagaatagcgaatgtaagttattaaataaatgagcaagaagnntgngtcagggannataaatgcttcttatattgttaataccgtgattccctgcccgctcancccgtcactcannactgatgcatttgntttggaaagtgccactttat

SEQ ID NO: 7427 - DNA, 298 bp, Zea mays
  misc_feature: Incyte ID No: 700381709H1
  unsure 269, 271, 274, 290: a, t, c, g, or other
ggacaagaagattcacgtgtacggctattccatggcctatggtcctgcccagcacgccatttcaactgagaaaatcaaagccaagtaccccgactacgaggtcacctgggctaacgacggctactgagcactcccagcccggggctgctgcctccagcagccacttcagagcccccgcctttgcctgcatcctcttgcaggggctgggcctgctggttctgtgggaagctctggtgacggtgctgtcaacaaggcttggagacaaggtnanctnggcacaggatttaaantgttgcca

SEQ ID NO: 7428 - DNA, 299 bp, Zea mays
  misc_feature: Incyte ID No: 700381711H1
  unsure 42, 56: a, t, c, g, or other
ctcgagcgagaaatttgctgcttgatgctgcaggaaatctcnaagtttctgacttnggtttaagtgctttaaccgagcaagtgaaggctgatggtctgcttcatacaacatgtggaacccccaattatgttgcccctgaggtgatcgaggatggaggctatgatggtgcaactgcagatatctggtcttgcggagtaatcctctttgttcttcttgctggatatttacctttcgaggatgacaacatcatcgccctatacaagaagatttcagaagctcagtttagctgcccctcttgg

SEQ ID NO: 7429 - DNA, 294 bp, Zea mays
  misc_feature: Incyte ID No: 700381712H1
  unsure 161, 187, 198, 206, 243, 271, 273: a, t, c, g, or other
tttatgtttcccgaatatgggtatcctgcatatccatttcctaccattccgttagtgtcaaacattcaagctgatggctatcagacaaaatcagctggcacaagttgccgaacttcagaagattccccaaaacagtcaagttcaatagaaatgtcacaagncgtaccatcgagaccactgtcaatgncaccaccaggnaagatagnaagcttaggggcgggaacaaatgcaagcgctgatagntattcagcggagcagcgacagtttgtcnanagggttggcagtggtccatgg

SEQ ID NO: 7430 - DNA, 171 bp, Zea mays
  misc_feature: Incyte ID No: 700381713H1
  unsure 11, 23, 25, 27, 35, 40, 48, 51, 60, 66, 84, 91, 94, 96, 99, 133, 136, 168: a, t, c, g, or other
ccgcaactgcngccgccactccnangntcgaagcnatgcngcccaagntcnacccgtcgnaggtgntggagttgttcgtccgtntaaccgncgncnagntcggcgaaggtcttggtggccccaaaaatcggcngtngggttttcccccaagaaaatcgagaggaatcncca

SEQ ID NO: 7431 - DNA, 293 bp, Zea mays
  misc_feature: Incyte ID No: 700381714H1
  unsure 14, 40, 212, 245, 281, 284, 292: a, t, c, g, or other
ctcgagcgtttgantctgccttttttcagcgacattccantgttgttggcgtccacgcgttcggtggcccgtcgtcccgatgcgccgtcaacgatgtcacccataggtgcagaccatcgacgatgtcacccataggtgctgacgagccatctcctattctcctacacatgctgcccctcccctccatcctttgatccaacttctcggtcgtngacgaacctgccagcttcgccggagatgagatnccaagctcttccccaaatgttgggcagcctcgtgtnatngtgtcgtna

SEQ ID NO: 7432 - DNA, 287 bp, Zea mays
  misc_feature: Incyte ID No: 700381717H1
  unsure 139, 181, 229, 249: a, t, c, g, or other
caaacccactccaccttactaccagacaaccttagccaaaccatttacccaaataaagtataggcgatagaaattgaaacctggcgcaatagatatagtaccgcaagggaaagatgaaaaattataaccaagcataatntagcaaggactaaccctataccttctgcatatgattaacttngaaataactttgcaaggagagccaaagctaagacccccgaaaccagangggctactaggaccagctanaggagcacacccgtcttgtagcaaaatagtgggagatt

SEQ ID NO: 7433 - DNA, 291 bp, Zea mays
  misc_feature: Incyte ID No: 700381719H1
  unsure 112, 216: a, t, c, g, or other
cagaaatgctctgctcaatctgttctattcatgcacaagaattggtcttctagtggtctgcttgagaaaatgaagaaactttctgaaagaaggaagcttgaagatttaacanttggtccagtcctacagttactacagaagccatgatagagcacatgaaacaaccttctcaaaaattagaggatcgaaggttctgttggtggtgaaccgttaggnatcactccattcccaaatttatggtgcccatgaaagctatggctgtatttgttcctctagaagaattccaaaaag

SEQ ID NO: 7434 - DNA, 289 bp, Zea mays
  misc_feature: Incyte ID No: 700381720H1
gcccaattttacacaataaatgtcttcagtccattggatataatgctgtttatcttccacttcttggagataatcttgctagttttctggagacatactcatctcctgacttttcaggatttagttgctcacttcctttcaaagtagatgctgtacagtgttgtgatgaacatgatccagttgctaagtcaataggagccataaacactataattagaagaccagatggcaaattagtggggtacaatacggactacatggagctatatctgctattgaggatggcatt

SEQ ID NO: 7435 - DNA, 290 bp, Zea mays
  misc_feature: Incyte ID No: 700381721H1
  unsure 24, 70, 271: a, t, c, g, or other
atgtgaggatgcgctgcggaaaancaaggccctgattgggccggaccagaaggagtaccaccgtgagctngagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgangggagtctgccctggtgcc

SEQ ID NO: 7436 - DNA, 212 bp, Zea mays
  misc_feature: Incyte ID No: 700381722H1
  unsure 104: a, t, c, g, or other
ggaagatgagtcaggagcctgaggatcctggtgaagttcctccgtgagacagcgggtcacgtggtgacggtggagttgaagaccggcgaggtgtaccgacggtnaactcaagtgcgaggataactagaattgccagctcaagaacattaccttcaccgctaaggtatactctctctgcctgcgctaccttcggatccgagatagaaccccag

SEQ ID NO: 7437 - DNA, 288 bp, Zea mays
  misc_feature: Incyte ID No: 700381723H1
  unsure 46, 118, 126, 185, 212: a, t, c, g, or other
tcctgtggatgttaaacctcgtttttttccccacacgatattaaancctaaagcaccagaaccagtcatggagaccagccagtttagatggtaagtcatatttctggtggtacacagnagaggaancccttcactctatctttaggtagaaatatttggaggatgtgacagcctctgagaaactnatgttactatgtggattttaaaaaatntaatactgcatgtaattgctataatgttcatatttgaggcagttgtgaaactggtttatgattgttggtgtactct

SEQ ID NO: 7438 - DNA, 292 bp, Zea mays
  misc_feature: Incyte ID No: 700381724H1
  unsure 14, 222: a, t, c, g, or other
ccataatgcttttnatcttcttgcaagatatggcaccactcaccttgtattcaatgatgatattcagggaacagcttctgtggttcttgctgggcttattgcagcacaaacattacttggtggttcattggcagatcacacttaccttttcctggtgctggagaggctgggacaggtatcgctgaacttatagctcttgagatctcacgtcagacgaaagcncctatagaggagtgccgcaagaaaatctgggcttgttgatcaaaagggctgattgtcagtacacgaaagg

SEQ ID NO: 7439 - DNA, 294 bp, Zea mays
  misc_feature: Incyte ID No: 700381725H1
gctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttgggggtcaagaaacagccagcaag

SEQ ID NO: 7440 - DNA, 299 bp, Zea mays
  misc_feature: Incyte ID No: 700381730H1
  unsure 62, 65, 71, 115, 118-119, 121, 137, 141, 143, 173-174, 183, 187, 224, 227,: a, t, c, g, or other
gcacacgagccgtcgccaactcgatcctcaccggtgacccctgccgcagcttcatatcatcntgntcttgntcttcatcttactgttaatttcctgccaatttaatcccaccggncanngntctcctgaaccaaagnaatngngcaagttggttccgggtccagcaagatcgnnaccaaagtnccanctcagacgaggagggggctcaaaccaagagctatggngantggtatcaaatctcccggggtataaggggggtgggtgtcgcnngtggcagtagcagaatantnggcggaacc

SEQ ID NO: 7441 - DNA, 297 bp, Zea mays
  misc_feature: Incyte ID No: 700381731H1
  unsure 14, 101: a, t, c, g, or other
gaagcgggcatttnctgcttttaagaaagcagcaattttagctgattctacacctgctgtccctgtggctcttcgtgttgaacctaaacctaaaagtgatntaaggcaacaagatcttttgaagaacattgttgggatcaaaccaaagcgaccaaaagttagcagcccttcacagccaccagatagcaataagcctaaacatacggaagaagaccctgtcggcgagttgtcgccatcacggaatccgttggggaccatctcatggggactgtgaatctgaccacacagggcaagggt

SEQ ID NO: 7442 - DNA, 281 bp, Zea mays
  misc_feature: Incyte ID No: 700381733H1
  unsure 235: a, t, c, g, or other
taaatcccgaagtgacatgacagttgaagagaggattgcagctgcagacaggagaaagattgagggcaatgcatatttcaaagaaaagaagcttgaggaggccatgcagcaatatgaaatggcgattgcatacatgggagatgatttcatgtttcaattatttggaaagtacagagacatggccttggctgtgaaaaatccatgccatctcaatatggctgcatgcctgatcaantaaagagattcgatgaagctattgcgcatgtagcatgtttgacaga

SEQ ID NO: 7443 - DNA, 297 bp, Zea mays
  misc_feature: Incyte ID No: 700381736H1
  unsure 14, 16, 27-28, 30, 34, 83, 187, 216, 232, 259, 268, 271, 277, 280: a, t, c, g, or other
atattcgccctgancnacacaacaaannangggntaaattcccgttttgtcactttttctgataaaagatggacacattaccncttttcggccccatgtatctcagtaccccatggagctgggctaagtaaataggaattggtttcacgcctgaggcaattagacactttggaagatggcataaccngtctcacctggacttaagcgtctggctcnaattcacagtggtccnttctcctcaatggaatccagggtcccncccagaggngcnaccagntcncagggtggcactcagcc

SEQ ID NO: 7444 - DNA, 279 bp, Zea mays
  misc_feature: Incyte ID No: 700381737H1
  unsure 91, 217, 239: a, t, c, g, or other
catccatttatcactggcaagtgacacaagatgacgattcctcttgaccttgaacttagcatcttcactgtaaaatacattttgggttccncttgtctaatcatcaacgtttctgtcttgtgtcctgggagctctgagaaaaagtacatggatgaagcacggaacttcggaagagatggctatctgcagaccttgttgcatgcacttatcatttggntatattctgtgcttgtaagacnactagccagttggcattccattcctgtgtacaatcttcct

SEQ ID NO: 7445 - DNA, 145 bp, Zea mays
  misc_feature: Incyte ID No: 700381738H1
  unsure 41, 60: a, t, c, g, or other
gggccgacgccctccgcgcgctcacccaaggtcgaagggancgaggagtacgttaagganctgcagccggtctccgtgccgcaaacggcggctaagccggtgaatgaggagcagaagcaggagagtccgcttccgcgtggccgcc

SEQ ID NO: 7446 - DNA, 283 bp, Zea mays
  misc_feature: Incyte ID No: 700381739H1
  unsure 216: a, t, c, g, or other
cccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctgaggcgggggcattgggtaacgaanaatggttgcgatctgcaagaattcagcatgtctcttgctgcttatcattgaacttcccattcttgtc

SEQ ID NO: 7447 - DNA, 275 bp, Zea mays
  misc_feature: Incyte ID No: 700381743H1
  unsure 44, 55, 85, 177, 179, 182, 255-256, 265: a, t, c, g, or other
cttcatctcccaggttttcccctccaatcacccccaggtcttcntctcgcgagtngcggtctcgcgcccccctccgccgaccgcngcctcctcacaaccgcggaaactgcttccctctccattggacgcggccagcttccatctctcggtcacctccctctacataccacggccgcnancancttccctctaactcaacggccggcggctctccaaggttgcaacggaatgtgtattgtgatgtgattcaaatgnnaagtgttanggttccatca

SEQ ID NO: 7448 - DNA, 161 bp, Zea mays
  misc_feature: Incyte ID No: 700381747H1
  unsure 3, 9, 17-18, 22-23, 28-29, 53, 78, 82, 95, 113, 145, 153, 157: a, t, c, g, or other
cantgcgcnacacgcanncatnnaacgnncgcaacgaaacccagtcggaagcnagaccggcgacaagtgcagcgctcnccgngatggattctgantacggcgtgccgcgcgantgtcggaggtgcagaagaagcgcgcgctctancagcccgngtgncccc

SEQ ID NO: 7449 - DNA, 293 bp, Zea mays
  misc_feature: Incyte ID No: 700381748H1
  unsure 3, 6, 19, 31, 59, 146, 254, 271: a, t, c, g, or other
ggnagncggtgcggaagancgtgtgcgtgancggcgctggcggcttcgtcgcgtcgganctggtgaagctcctcctctcccggggccaatacgcggtccgcggtaccgtgcgcgaccctggtgctagcaagaatgcccatctcaangtgctggaaggagctgaggaaaggttgcagcttctcaaggctgatctgatggactacaacagcattgcatcagcagttgccggctgtaagggtgtcttccatgtagcnatccggtctttcccatngacctccaaccctgaggtgggg

SEQ ID NO: 7450 - DNA, 327 bp, Zea mays
  misc_feature: Incyte ID No: 700381749H1
ggaagatactgtcggaatcggcatcttcccctccagtccctcgctctaccaccagcagcaaccgctgtcggaggagggcgtggttgggggaagtgccgcagcgggaggagataaagcgttctccaatcttccaatccccttcggctgccacttgttctagtatctagttagttgtgaactttaaaataggttaaataaatacatgggagtccaagaagattctaggccttctggggccctgggtggcctatacagggtacagtttgtgggccggtcaatatacagtgatgacgaagcagtcaagactagcattatggattcttcaac

SEQ ID NO: 7451 - DNA, 323 bp, Zea mays
  misc_feature: Incyte ID No: 700381750H1
  unsure 39: a, t, c, g, or other
gtgaaagatgcctactgcttgctgaacttcggggacagncttactacagatcacatttcacctgcaggaagcatacacaaagacagtcctgctgccaagtatttgatggagcgtggtgtggaccggaaggacttcaactcatatggtagccgtcgtggtaatgatgaagtaatggcaaggggaacgtttgcaaacattaggatcgtgaacaagtttttgaacggagaagttggacccaagaccattcatgttcctactggggagaagctttctgtttttgatgcggccatgagatacaaatctgagggccatgctactataat

SEQ ID NO: 7452 - DNA, 224 bp, Zea mays
  misc_feature: Incyte ID No: 700381752H1
caaagtgctctcacaccttccatcagccttgtgtggacagatggttcattgaccatggttcatgcccagtatgtagacaggatgtgtaggtagatcatgatcgattctgggttatcatgcctttgtaaagttgctaccctcgtcatatagaagaaagatacagtacgtagcatgtaaaaagtcctgcacttgttcctattatgaaaaatggtttacacatcagt

SEQ ID NO: 7453 - DNA, 323 bp, Zea mays
  misc_feature: Incyte ID No: 700381756H1
  unsure 15, 77, 113, 126, 148, 155, 187: a, t, c, g, or other
cagagacccagccanggcgatctcccagatctcacgcatattcctggccatccttctcctggccgccgccttgcgcngccgcgcccagctgcgcttgcggatcggcgacgacntggtggcccttancgaatccacgttcgagaaggangtcgganaggaccgcggcgccctcgtcgagttctatgcnccctggtgtggtcactgcaagaagcttgctcctgagtatgaaagacttggtgcaagttttaagaaagctaaatctgtcttgattgctaaggttgattgtgatgagcacaagagtttgtgcagcaagtatggagttt

SEQ ID NO: 7454 - DNA, 308 bp, Zea mays
  misc_feature: Incyte ID No: 700381757H1
  unsure 52, 219: a, t, c, g, or other
gccccaccggggtgctggggcagtagtcatggcagactcccggcctgggccnccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcancctcttctgtccctttcagtcatttgctgtacttccctgtggcacgttaccatggaagccgctccagggtgggtcagggtgcaagctgc

SEQ ID NO: 7455 - DNA, 309 bp, Zea mays
  misc_feature: Incyte ID No: 700381758H1
cggacctaggtcgcggcgacatggccaaacgtaccaagaaagttgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctct

SEQ ID NO: 7456 - DNA, 319 bp, Zea mays
  misc_feature: Incyte ID No: 700381760H1
  unsure 23, 281, 301, 308: a, t, c, g, or other
caacacctccagcaaccattacnagctttggtgttgctacccctgtttcaattaccacatcgaccaccccttgctggtgctgcaaggagcacacctctgagacctgtgaggatgtctcctggctcccatcagaaatacagcacgccaccaaaaaagggtgagggtgaacttccaactccaatgtccttagagcaagcagtggaggcctttgagaacttgggtgtatatcctgagattgagcagtggcgagatagtctcaggcagtggttttcttcagttgngatgaacccacttgtacaanaaatcanaacaagccata

SEQ ID NO: 7457 - DNA, 318 bp, Zea mays
  misc_feature: Incyte ID No: 700381762H1
  unsure 251: a, t, c, g, or other
ccgtttggaagcttccggttggatgggatccctcctgcacctcgtggtgtcccacaaattgaagtgaagtttgatattgatgcaaatgggatactctcagttgctgccattgataagggcactggaaagaaacaggacatcaccatcactggtgctagtacgttacctaaggatgaggttgagagaatggtagaagaagccgataagtttgccaaggaggacaaagagaagagagatgcaattgacacaanaaatcaggccgattctgtggtctaccagactgagaagcaactgaaggagcttggcgataaagtcccc

SEQ ID NO: 7458 - DNA, 314 bp, Zea mays
  misc_feature: Incyte ID No: 700381763H1
gccgccggccgccggcaatggaggccgtggcgcgcaggcggactacctttggcggttcgtggcggagacagagtggtacaacgaggttgtcctcagcgccgtggcgccaggcgactggtggcgcggcctgccgcacccggtgcagtcatggatgcgcaactgcgtcggcggttacctcctctatttcatctctggtttcctctggtgcttcgtcatctactactggaagcgccacgcctacatccccaaagatgccatccccacaaatgaagctatgaagaagcaaatagttgtagcatcgaagctatgctttt

SEQ ID NO: 7459 - DNA, 318 bp, Zea mays
  misc_feature: Incyte ID No: 700381764H1
gaagaacaactgttcattgaggaagagaaggagaaaagattggaagaaacctttgaggctgatttagaaaacgataatgactatagatatgggcagaaagatgatgcccctgatgaaggttctgtgggtgttcctggtaggaaaacaaaagagacagtaacttctgctgatgcaatcatggatgcacttgacactgctgaggaggaactaaaacgcattaatcaacataaaatggaagagcaaattactgcgaaggcagctaaatttcaacctaatgttataatgcaagggcattcaccttcagattatgttctaaat

SEQ ID NO: 7460 - DNA, 313 bp, Zea mays
  misc_feature: Incyte ID No: 700381767H1
ccactctctcgatccaaagccagatcggcacgacgagcagagggccccccggagcggcgcggagaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgctggccaggaacgatatcgtgctattactagtgcgta

SEQ ID NO: 7461 - DNA, 312 bp, Zea mays
  misc_feature: Incyte ID No: 700381768H1
  unsure 52, 293, 300: a, t, c, g, or other
gtctcatagttgtgttaagcttgcgtagaattgcaggtctctgtacgggccnctttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactntctcttntgttttaaatga

SEQ ID NO: 7462 - DNA, 304 bp, Zea mays
  misc_feature: Incyte ID No: 700381771H1
atttcgatcatccattatcgcccaatgcttcggtactacctctaatgatgacacggcttgtaaggatggaaactttgccaaccagaacgacacctgtaagggtgaaaattttgtcaaccagaaaaatgtcacaatgtaccaatctaatttgaccatggaacctatacctcgagctcaaataaatgtggattgtttcacttcttcctgttcaatgactcctgaaatcaaggactatggcaacagaggtgaagatcgtgcgaaagaagcactagtgaactcacaaaacatgacaagtaatgaaact

SEQ ID NO: 7463 - DNA, 313 bp, Zea mays
  misc_feature: Incyte ID No: 700381772H1
  unsure 106: a, t, c, g, or other
agcgatcagcgcagattccttccacgctccccctcctttccaggtcccctcgcccgcgctctcagatctcgcgcgcctcccacaagggaaaccttgagccatgggnacagttgtggatgccgctccagcagttgtggctgaggtcactgagaacatgttgggtggcaagaaagttacagttgtatttgttctaggtggtcctggaagtggaaaaggcacacagtgtgccaacatcgtggagcactttggattcacccatcttagtgctggagatcttctgcgtgcagagattaaatctggctctgagaacgga

SEQ ID NO: 7464 - DNA, 317 bp, Zea mays
  misc_feature: Incyte ID No: 700381773H1
  unsure 3-4, 10, 25, 38, 46, 67-69, 73, 76, 82, 90, 95, 99, 115, 158, 168, 179,: a, t, c, g, or other
gcnncaactnggcggccgtcgctgncgccctacgccangtgccgancaggagccacagtcgcagcannngcangancagganccgcagtnctcancgangagataggttgcgcancgtacgtgcaccccgccgcagtcgcagtcacagcaggagccgnagcccatacngtcgcagagancggcgtggatacaangatctcgtatgcaagaactgctcgganaccngggcactttgctaaggagtgcccatctgcgcctacgtgcaataactgnacagttccaggccanttcgcagcagnntgcacctcaaaanctgt

SEQ ID NO: 7465 - DNA, 312 bp, Zea mays
  misc_feature: Incyte ID No: 700381776H1
  unsure 21, 25, 33, 37, 40, 60, 66-67, 84, 101, 114-115, 134, 136, 139, 153, 159,: a, t, c, g, or other
ggagctaccagtgtgcatgcnctgngcagggcnacancangacggccaacgggaggtccngcaagnnactggatgagtgtgcantgggtacccacaactgntccgaggctgagnnctgccacaacatccagggnanctnccgctgcctgcgcntcgagngtcctcccaactatgnccaannctccaaaacgnagtgacgagcgcaccacgtgccatgacttcctggagtgcnaganctcgncagngcgcatcangcactancagctcaacttccagacgggnctcctggtgcntgngcatatcttccgnatt

SEQ ID NO: 7466 - DNA, 311 bp, Zea mays
  misc_feature: Incyte ID No: 700381777H1
  unsure 2: a, t, c, g, or other
angcgatcgcatattcgcacccacccatcacacgacaaaatccctcaccctcgtgagtcctgacgccctcgcccgtgctcgcagttggtagggttgtagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcataggccctt

SEQ ID NO: 7467 - DNA, 309 bp, Zea mays
  misc_feature: Incyte ID No: 700381782H1
accaccactgctaccatcggttccccaaaccctagccaagggacacggtggccagcgatggacggcgacagagaaggcgctgcggcggtgcaccaccacgcgcgctcccccgaggacgtcttccgcgatttccgcgcgcgccgcccggcatcgtcaaggcactcaccacggatgtggagaagttctatcagcagtgcgatccagagaaagagaacttgtgcctttatggtttgccaaatgagacttgggaggttactcttccagctgaggaagtacctcctgagcttccagaaccagcactgggcataa

SEQ ID NO: 7468 - DNA, 308 bp, Zea mays
  misc_feature: Incyte ID No: 700381783H1
  unsure 37, 58-59, 113, 181, 225, 229-231: a, t, c, g, or other
ggagccagtcttggggcccgcttctaccggcagatcncaaagacatccggggatcatnncgttgatcggcttaatctgcctgggcatgggcagcgctgcgctttacttgctgncactcgcccttcgcagccccgacgtctgctgggacagaaagaacaacccggagccctggaaccgcctnagccccaatgaccaatacaagttccttgcagtttccactgactncaannntatgaagaaggaccggccagacttctaagccaggctgggctgccagtgccatgcaagccacagccagccagcccatc

SEQ ID NO: 7469 - DNA, 211 bp, Zea mays
  misc_feature: Incyte ID No: 700381784H1
  unsure 32, 152: a, t, c, g, or other
accgtgggctgttacttgctttgagttggaancggtttgcatttacgcctgtaaatgtattcattcttaatttatgtaaggttttttttgtacgcaattctcgattctttgaagagatgacaacaaattttggttttctactgttatgtganaacattaggccccagcaacacgtcattgtgtaaggaaaaataaaagtgctgccgtaacc

SEQ ID NO: 7470 - DNA, 310 bp, Zea mays
  misc_feature: Incyte ID No: 700381786H1
  unsure 3, 5, 15, 17, 19-20, 28, 31, 35, 37-38, 41-44, 46, 88, 94, 107, 180: a, t, c, g, or other
gtngncgctgaaacncnannccgctganatntatncnnatnnnnanttgatggtcgtgcggaactgctccagtttcctgatcaagagnaataanccagacctacagncactgagcccaataacttgaaggcccgcaattccttccgctacaacggactgaatcaccgcaagactgtgggngtggagccggcagccgacggcaaaggtgtcgtggtggtcattaagcggagatccggccagcggaagcctgccacctcctatgtgcggaccaccatcaacaagaatgctcgcgccacgctcagcagcatca

SEQ ID NO: 7471 - DNA, 307 bp, Zea mays
  misc_feature: Incyte ID No: 700381787H1
  unsure 2, 94, 134, 219, 271: a, t, c, g, or other
gnctccttcccgctgccgccgtctcagcgagcgagactgagctgtgcttagtaagccatgtcgctgcgcccgagcgagcgggtcgaggtgcggnggaaccgctacaaggtggcggttgacgcggaggaggggcngcggcggcgcgaggacaatatggtggagatccgcaagagccgccgcgaggagagccttctcaagaggcgccgcgaggggctccangcccaggtccctgcccctccctcgggggtcgagaagaagcttgaaagcctcncagctatggtcagtggggtttattcggatgacaata

SEQ ID NO: 7472 - DNA, 306 bp, Zea mays
  misc_feature: Incyte ID No: 700381788H1
gagtcttgttgtctgatatttgccactgagctggtgaagcccctctaaagagatctcgaccctggggagcagaattcttgtacatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatg

SEQ ID NO: 7473 - DNA, 305 bp, Zea mays
  misc_feature: Incyte ID No: 700381792H1
gtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcac

SEQ ID NO: 7474 - DNA, 303 bp, Zea mays
  misc_feature: Incyte ID No: 700381793H1
  unsure 277, 287: a, t, c, g, or other
gctggctctgccaaggcaagaacagagctgctggaggggtgggggcggaaggagcctgcttaggactgctctcagctaccggcctcctctggatgacgggactgcaggaaccacgagaaccccagttctagctcccggggtgggcaggctgcttggcaggcaggccgccttccctccaccaggagtcaggtctccagccagaggtcctgacccagggcacaagtgctcgcactgggaagcaggcctctgaggcaggacgtcttctcctgtggtggantgggggtgtnggcagggcaaggaggc

SEQ ID NO: 7475 - DNA, 223 bp, Zea mays
  misc_feature: Incyte ID No: 700381795H1
  unsure 100-101: a, t, c, g, or other
atcagatgcccaaaattcccggctcgaagactgcaggcatcggacgcgccccccgccgagaagctactcgaatcccctccaaaattcggaggcgagagcnnctgatctatcgcaaaacccatcaaattacacaattcaaatcagccaaccccacctacagccaccaattcgtgcgcatcaagtctagccccctaccccttcgcaatcagtgaacccccaatcc

SEQ ID NO: 7476 - DNA, 298 bp, Zea mays
  misc_feature: Incyte ID No: 700381801H1
  unsure 72, 94, 282, 297: a, t, c, g, or other
aaacaagaaaaagaaaagaaaacccccgctgccagcgacagaagaagaaggggtcccttctccttggttgcnttgcgcctccctcctgtctgcntgcgtgcaatcgacgcagaggcgcgggcgctcgcaccaccacgaccacgacccgatggctttcatgcgctcccgctcaaatgcatcttctggcatgggagttgctcctaacattagggagacattcgtcgagcttcaaatgaagaaggcatccgatatgttaacttcaaaatcgagagaagcaaaacnagttgttgtggagana

SEQ ID NO: 7477 - DNA, 298 bp, Zea mays
  misc_feature: Incyte ID No: 700381802H1
ctaggcccgaccgcccgaggaaggaagagaaacccgcagagggcgagagaggtcagcgcgattcggagatgggcatgggcgacgaactgtgggacgactcggcgctggtcgtcgccttcgaccgcgccatttccacgttcaatgaaatgcattgcaagagcagtgcgaagaaggaacacgctgctgctcctgcagcagaagaggagcccattactgcaggagcagtggatgcagaggaagatgccaactgtgacaacgcacagacagttgagcaacagcagctctctgacgacaggca

SEQ ID NO: 7478 - DNA, 293 bp, Zea mays
  misc_feature: Incyte ID No: 700381804H1
  unsure 253, 256-258, 262, 265, 269, 278, 283, 291: a, t, c, g, or other
atcgagcgccagatggccaacgccaggctattcgcagaggaacagctcgccgaggatctcgcgctgaagaggggcatctccgtgggcgctgcggcaaatctgctggctgctggaggggagaaggacgacgacatcatcttttgatcgcctctttccatgctcatccaatcattcaatcgccccggaaacaataagttgatgctggaactccagaactgtacctgtttatagagtgatggcggttttttttttngtnnnagtngtnatcnggtgcctgncatcnaagacagntg

SEQ ID NO: 7479 - DNA, 295 bp, Zea mays
  misc_feature: Incyte ID No: 700381805H1
cacataacacaactagtgaaggatacatcagacaagcttaaacaagctagcgaggcggatcatcgcgttgaagtcagcgctaccaaaaagattgctgatgcaaagctagctaaagatttccaagcagtcctaaaagaattccagaaagctcaacgattagcagtagagagagaagctgcatatgcaccttttattactcaagcgggcctgccacagagctacaactcaagtgaagtgaacaatggtgctgataagttggcagagcagcgcacgcagcttctagaatctagaaggc

SEQ ID NO: 7480 - DNA, 293 bp, Zea mays
  misc_feature: Incyte ID No: 700381806H1
  unsure 48, 129: a, t, c, g, or other
ggcgagctctcagtgctgcgataacccgccggccctgaacccggcctnacggggagggcaaggtcgtcgacagcttcggcgggctcaaggcctacgtcgccggccccgaggactccaaggccgccgtcntcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacat

SEQ ID NO: 7481 - DNA, 289 bp, Zea mays
  misc_feature: Incyte ID No: 700381807H1
  unsure 215, 271, 279: a, t, c, g, or other
aaacgctttctactctgaagcacacaggggctggggctggccttcggagttacgaggaaacgaggaccaggaccagggattctgcatcagcacagccgccaggagccggccggggccccatccctgacactgctgtcgcccggctgtacctgggtgctgtgtccgcggggctctggagacgtcgatgtggtcatagcagggcctggaacggggangtctggcctgaactagagaaatgaggggcgtatccgcttctccaccctggcctcanatgaagangctctggggg

SEQ ID NO: 7482 - DNA, 290 bp, Zea mays
  misc_feature: Incyte ID No: 700381808H1
ggagaataagcatgaatatgtcgaccgggtagcagagcatcgattgaccactgccatcaggcctcagattaatgccttcctggaagggtttaatgaactcattccacgggagctgatatctatcttcaacgacaaagagcttgagcttctgattagtggtctccagatattgacttggacgatttgaaaacaaatacagaatattctggctacagcatagcctctccagtcgtccagtggttctgggaaatcgttcaggggttcagcaaggaagacaaagctcggttcct

SEQ ID NO: 7483 - DNA, 290 bp, Zea mays
  misc_feature: Incyte ID No: 700381810H1
gctgaatatcaatccaaagatcttggtctactagttgaggatacaacagtggagcagcttggcatagctcggaaagttacaatctcaagttcctcgacgaccattatagcagatgctgctagcaaagacgatatccaggccagaatcgcgcagtgaagagagagctttctcagacggactcgacgtatgactctgagaagttggcagagagaattgcaaagctttctggtggagttgctgtggttaaggttggagcatcgaccgaggcagagctagaggaccgcaagctc

SEQ ID NO: 7484 - DNA, 290 bp, Zea mays
  misc_feature: Incyte ID No: 700381812H1
  unsure 169: a, t, c, g, or other
cgcgtggtctacgccgagtgacagagacgctcaggctgtgttctcaggatgaccgagtgggagacagcagcaccagcggtggcagagaccccagacatcaagctctttgggaagtggagcaccgacgatgtgcagatcaatgacatttccctgcaggattacattgcantgaaggagaagtatgccaagtacctgcctcacagtgcagggcggtatgccgccaaacgcttccgcaaagctcagtgtcccattgtggagcgcctcactaactccatgatgatgcacggccg

SEQ ID NO: 7485 - DNA, 286 bp, Zea mays
  misc_feature: Incyte ID No: 700381814H1
  unsure 63, 139, 150, 171, 202, 208, 210-211, 215, 222, 229-230, 234, 238-239, 250,: a, t, c, g, or other
caaagttgtttgtgcatcgcggcggcgacaagggggcgacgaggcaggcggacgggcggcgantacagcggcagcagatctcacggaatggcggcgaaggcaatctcgagccccgtgccggtggagtggtacccgacgntggccgtcgtnatggtatccgtaggcctcatnttcaccgcctccttcttcatttatgaagctncttcancnnggancatagtngtcaaannaatngctnnaacaattgttncttcnttttctttggctntgctctntnctcnnccnc

SEQ ID NO: 7486 - DNA, 291 bp, Zea mays
  misc_feature: Incyte ID No: 700381815H1
  unsure 126: a, t, c, g, or other
gtgttttatactttgcaaagcactttattagctcacacctgtccactcacatgaaactcgtgttaggccctgggaggccgacggtaactctcaccgtgccctcagatgaagcacagagaggttgtnacttgcccgggccatccagtgggctggctgggtcttgtgtccccatctgtggacccctctagggtctgagatgagatgagaaagtgtctcctgtatccacctcttcctggcctcccttcccccattcctggtccctgtccactcctcaggttggtgtctcattct

SEQ ID NO: 7487 - DNA, 294 bp, Zea mays
  misc_feature: Incyte ID No: 700381817H1
  unsure 109, 282: a, t, c, g, or other
taaaaactgagggaattcagagacctgtgccagtgcaggtccttagcatgctaagcgcaggtcccctgggcccgctgttgtttctctatactttgtctctgtgtctganctcttttctgtctctcatcccacccgacaagaaatacccacaggtgtggaggggcaggccaccccttcagtatgagattacaggcatgaataaccccacctggccacctaactcactcttgagaggccagaagtgatgctggaactttcttcctctgtgggtgaaaaaggganaattagggagaa

SEQ ID NO: 7488 - DNA, 290 bp, Zea mays
  misc_feature: Incyte ID No: 700381818H1
  unsure 54, 249, 254: a, t, c, g, or other
aaccaaacccagctacgcaaaatcttagcatactcctcaattacccacataggntgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggnctgcncccgctaacggctttttgcccaaatgggccatatcg

SEQ ID NO: 7489 - DNA, 292 bp, Zea mays
  misc_feature: Incyte ID No: 700381819H1
ggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaa

SEQ ID NO: 7490 - DNA, 49 bp, Zea mays
  misc_feature: Incyte ID No: 700381820H1
  unsure 2, 29-30, 32, 48: a, t, c, g, or other
cnctaactttaaatcagatgactgttgtnnangcatattttggcgcana

SEQ ID NO: 7491 - DNA, 286 bp, Zea mays
  misc_feature: Incyte ID No: 700381821H1
cggcgatcagggggagggagccgctttggtggccgtgacttccgcaatgattcttcgtcatttggcaaggggggatcccgtggtggtggtgactactatggtggaggcagcagtggtggttatggtggtggcggacacggtggagctggggctccgagtgcctgggattgatgttacagttgctcccaagtagaggggtctgccaagtttaggtcactttttactctagttctatttaggtatacatttttggtaggagctgttatacagcaacaagtacaaggtg

SEQ ID NO: 7492 - DNA, 286 bp, Zea mays
  misc_feature: Incyte ID No: 700381824H1
aggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgtattggggcttatgtcaaaaacaagaagaatcaaaaccagatatgctggttatgggaaaaggtaaaatcaacagaagacagagattttcaaagattcctggacaacgtgcaatac

SEQ ID NO: 7493 - DNA, 286 bp, Zea mays
  misc_feature: Incyte ID No: 700381827H1
atcggaccatcaaagaagcatcccaaagttgatgagcaggtaccattacctgatagtcatctctcttgtattcttgaatttgatggtgcctctaaaggaaatccagggaaagccggtgctggagcaataataaggcaggtagatggttccgtgattgctcaactacgtgagggtctgggcattgcaaccaacaatgctgctgaatatcgtgcattgatcctagggctaacatatgcagccaagaaagggttcaagtatattcgtgctcaaggcgactctaagcttg

SEQ ID NO: 7494 - DNA, 96 bp, Zea mays
  misc_feature: Incyte ID No: 700381828H1
aggttcgtcacaaaaatgttgtgcaatttattggtgcatgcacgagacctcctgttttgtgtattattacagaattcatggcatggaggcagtatt

SEQ ID NO: 7495 - DNA, 291 bp, Zea mays
  misc_feature: Incyte ID No: 700381831H1
  unsure 78, 127, 148, 151, 157-178, 246, 261, 269: a, t, c, g, or other
cggcacaatagatgttctcactgatcttcctcttactgacttaaatgtcgaaaacaaccaattcacaggttggatacncgataaactaaagggaatcaataatctccagacaagtggaaactcgttncaacaatggccctgttccacnacntccccnnnnnnnnnnnnnnnnnnnnnngacaaatacccctcctccctctcggcagcatgctgttccaagtagcgtggtaaaaatggccctctggnaaaggggggaaaacncccgcaanttggggggggcccaaaacagga

SEQ ID NO: 7496 - DNA, 285 bp, Zea mays
  misc_feature: Incyte ID No: 700381832H1
  unsure 3, 12, 15, 22, 24, 29, 35, 40, 51, 78, 86, 95, 115, 122, 143, 146, 149,: a, t, c, g, or other
gtnagacacacnatnctgatgngnaacangatcanccatncgctgcccttnatgatcaaggttgaggcttaagtgganacaggaangcaagttcngggttccatgccttttcagngcatgangtcaggctctgtatccctccnttnacnagctgntattcnaactataaacatttgtcaantcctnngactcccaantggacaanacacgttcattttccaaccttcctagcagctaaaccttcnctgngagantagaagacagnattgcttgatanttcagggc

SEQ ID NO: 7497 - DNA, 290 bp, Zea mays
  misc_feature: Incyte ID No: 700381833H1
gctgaagctgcccatggcacggttacccgtcatttccgtgtccaccagaaaggaggcgaaaccagcacgaacagcattgcttcgatctttgcatggacaagaggacttgcccacagggcaaagctcgacgacaacgctagactactcgacttcgctctcaaactcgaggctgcttgcgttgagaccgtggagtccgggaagatgactaaagatctggcgattcttgtccatggatcttccagcgtcacgagaagccattacctgaacaccgaggagttcatcgacgcatg

SEQ ID NO: 7498 - DNA, 286 bp, Zea mays
  misc_feature: Incyte ID No: 700381834H1
cagatgttcatggacaacaatggaagcactgaagatatgggtcctcgaccttttcctgtcaaggaggttcataaaatagcagtactagatattaggttagctaatgctgatcgtcatgctgggaatattctagtgtgcaaggagagagaaggtggcaactacaagctgattccaattgatcatggttactgcttgccagagaaggtggttaatatctgttacaatacgtatttggttcatctgcttgcaccttatttgtttcatatggctgattagaaacttacgt

SEQ ID NO: 7499 - DNA, 283 bp, Zea mays
  misc_feature: Incyte ID No: 700381835H1
gtcaggtcgacggcgaaagacgcggaggttggtgaaggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcattgcgtatcctctg

SEQ ID NO: 7500 - DNA, 290 bp, Zea mays
  misc_feature: Incyte ID No: 700381836H1
tttgtccgtcagcttcatcagcatcatacttctacccatcgtggggaacgccgcggagcacgccggagcaatcatttttgctctcaagaacaagctggacattaccctcggagtagcgttggggtcggcgacccagatctccatgtttgtggtgccgctgagtgtcattgtagcttggatcgcgggtattcaaatggatcttgacttcaagctcatagagaccggctctctcttcgtctcagtaatagtgacagcattcaccctccaggatggttcgtcacactacctca

SEQ ID NO: 7501 - DNA, 63 bp, Zea mays
  misc_feature: Incyte ID No: 700381837H1
  unsure 22, 24-25, 28, 46, 53, 59: a, t, c, g, or other
ctccgctgggccaccagctttnanngcngcctcccttcccctccgntactgcnacctcnccac

SEQ ID NO: 7502 - DNA, 283 bp, Zea mays
  misc_feature: Incyte ID No: 700381839H1
  unsure 199: a, t, c, g, or other
gtcagtgagtactaccagaatagaggatgcttcagtgaacttattgctctcatggagagtggtcttggacttgaacgtgcacacatgggcatcttcacagaattgggagttctgtatgctagataccgctctgagaagcttatggagcacatcaaacttttctgccacccgtctcaatattcctaagcttattcgagcntgtgatgaacagcagcactggaaagaacttacctacctgtacatacagtatgatgaatttgacaatgcagtcaccactattatg

SEQ ID NO: 7503 - DNA, 281 bp, Zea mays
  misc_feature: Incyte ID No: 700381841H1
  unsure 30, 172, 263: a, t, c, g, or other
gaagtatgagaaggtgcttgtggaaggggncccggctccctaggcgtcccatctcgcttcctgggtctgcaggtccagccggctggcaccctccatgtacccaggggagattccagccagacacccgccccccggccctggctaagaagttgcttcctgttgccagcatganctaccctcgcctctttgatgccatccgctgccacctccttttgctcctggaccctttagcctctctgcccttccactctctgaccaccgcncccgccctccccacccag

SEQ ID NO: 7504 - DNA, 284 bp, Zea mays
  misc_feature: Incyte ID No: 700381842H1
  unsure 7, 13, 22, 25, 34, 46, 55, 57, 72, 75, 89-90, 108, 111, 182, 200-201, 207,: a, t, c, g, or other
tcctgcngccgcntcccagacngtntcctccgcnccagccgggatnccgacggtnancgtcggcctggatcntcncttggatgcgattnngtcccaacctacacacangcngagttcgaggcgctctgcttcgagttcggcatcgagctggacgatgtgacgacggagaaggctattatcangaaggagaagcacctcgnngacganagtnaggtggacnaagatgacgaggtcatctacaanatagaggttgccgccaacagatatgatttgctatgtcttga

SEQ ID NO: 7505 - DNA, 277 bp, Zea mays
  misc_feature: Incyte ID No: 700381843H1
  unsure 75, 181, 184, 205, 269, 276: a, t, c, g, or other
aacaaacatgttggtctctaagcagccagcctctttcactggttctgaggttcgaatcattgatgatgacatgcncctcgctcaatttgctgttgctttcaatggagcatcatgggtggatcctgattctgttgcactgatggttatgcaaacaatgctggttcatggaacaagagtgctngtngaggaaagcacatggggtcanagctgtgcagagggcagcaatcaatgacatcgctgagagtgtaatgggattcaatacgaatacnaggacant

SEQ ID NO: 7506 - DNA, 280 bp, Zea mays
  misc_feature: Incyte ID No: 700381844H1
  unsure 3, 39, 50, 58, 67, 79, 87, 106, 111, 115, 131, 186, 188, 212, 227, 250: a, t, c, g, or other
aangaggaactcttgatcaagatgcccaaccctgtgatnagaacctccanatactgcnatgagaaantagagggcaggnctcataanagccctttgaacccccttnctgcncagngttaggagataggganattggcccctcactgcagctgccagcacttggtcagtcactctcagccatagcantntgttcactgtcctgtgtcagagcntgagctccacccttntctgagagttattacagccaganagtgtgggctgaagatggttggtttcatgt

SEQ ID NO: 7507 - DNA, 284 bp, Zea mays
  misc_feature: Incyte ID No: 700381847H1
tcctcctcctcgttctactgcgccgccccttctagaatcatccagaggcgtgccggtgaagcgcgagagggtgaggcatggcgatgcagacgggggtcgcgacctccaaggtcctcatcctcgtcggtgcagggatgacgggctcgatcctgctgcggaatggccgcttatctgatgtgttgggagaactccaggagattatgaagggtgtaaatcaaggaacttcttcgggtccctatgacattgcacttattcaagctcagattcggaatttagcccaagaa

SEQ ID NO: 7508 - DNA, 313 bp, Zea mays
  misc_feature: Incyte ID No: 700381853H1
  unsure 119-120, 123: a, t, c, g, or other
agcggggcagctggatccgaggcaacatctgccatgatgcagaggttctgggattcagcaatgtccattggacctattgatgatgacgatgactcgagaagtgaagggtcgactagagnnacnatctgaggcaacagatataggaagaccagccttctttccagcttctggcttatcaaacacttttgggttcaagattcaggataagcaagggaggatgcacagatttaactgtgaaacaagcggcctggcagagctgataaccagcattcttcagagggtcggcgacgacattgacagaaaacacctgccg

SEQ ID NO: 7509 - DNA, 308 bp, Zea mays
  misc_feature: Incyte ID No: 700381855H1
attcctaatatggtttgtgaaatggaggaacttgaggctcttgctagaaatctttcacttgaggatgaagacctagatgatgatcatgatgatggaccagaggcatcgttgtaagcttgttgatgaagacctagatgatgataatgcaacatgaatgctctgaatgtttttattgtacttgttgcgtaatgctttgtgatcttgcgaacttgggacttgtggacttgtggctgtgtactttgtgatctgtgtgatgaacttgttatattgtgaacttgtgatctgtgtgatccacttattaaaaaaaa

SEQ ID NO: 7510 - DNA, 311 bp, Zea mays
  misc_feature: Incyte ID No: 700381856H1
  unsure 28: a, t, c, g, or other
aattttaataatcaacaccctcctagcnttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaa

SEQ ID NO: 7511 - DNA, 269 bp, Zea mays
  misc_feature: Incyte ID No: 700381857H1
cttgggactatattatgcttttgcttcttctgattttatctgatcattttcaaaatatcaataacagagctgtacttctaagaggtcaagtggtttggagttctataaagctataaggatgggcagaacctaggaaatgctgttagtaaaggagaaaaataaaatctaatggctagtaggaacaagggaattttagggaagatgagcttcccagttatattgagaggtccctttccacagtaagtagtagtttgatagagagattacat

SEQ ID NO: 7512 - DNA, 310 bp, Zea mays
  misc_feature: Incyte ID No: 700381860H1
  unsure 20, 23, 27, 29, 33, 39-40, 42, 46, 76, 78, 86, 101, 115, 120, 127, 202: a, t, c, g, or other
gttgccggttagtggcgcantcnacanangggntcatgnngncagncgtggagcccctgacgcaagctttaaaggnantcgacatnaagaagcctctggtntctgtctactccancgtcnacgggtntagatacaggcatcccgggcacatccacaagctgctggcccagcagctggtctccccagtgaagtgggagcagangatgcatgccatatacgaaaggaaaaagggcagggggttcccccaaactttcgaagtaggccctggcaggcagctgggagccatcctgaagagctgtaacatgcaggc

SEQ ID NO: 7513 - DNA, 310 bp, Zea mays
  misc_feature: Incyte ID No: 700381862H1
  unsure 28: a, t, c, g, or other
gggaaatttacaaggccaggacgtgtantaaggcctggagcaataaggatgaatgggaaatgtccactgactcctttggaggttggattaatgctgcgtggaatgggttttaacaataatactgcaatatatttagcttctggaaggatatataaagcagaaaagaacatgtctcctctccttgaaatgttccccctcttgcagacaaaagaaacattggcactggatgaagaacttgctccattcaagaacttctcctcaaggatggcagctattgactacagtgtctgtgttcatagtgaggtttttg

SEQ ID NO: 7514 - DNA, 312 bp, Zea mays
  misc_feature: Incyte ID No: 700381864H1
  unsure 14, 68-69, 78, 83, 87, 107-108, 116, 124, 154, 156, 165, 169, 173, 176,: a, t, c, g, or other
gtggtggtcactgnggaggagactgccaccaagacggtggaagcaatcgaggaaaccgtcgtgtccgnncccgccgcnatccnggangaagcagcggcgccggaggnngtgtcgangctcaggngaccggcctgaacccgtgctgatttggggngngccgctggncggngacnacnagcncacggacacggttctgctcaagttcctgngtncgcgggagtncaaggtgaaggatgccatggcngatgcncaannccncngtgctgtggcgcaagncttccggcatcagtcgctctcgaggtcgactttgct

SEQ ID NO: 7515 - DNA, 312 bp, Zea mays
  misc_feature: Incyte ID No: 700381865H1
  unsure 25: a, t, c, g, or other
gagaaagaagaaaggcatagcagcnggcagcggcatgggcaccagccccgtcatccctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgaggc

SEQ ID NO: 7516 - DNA, 315 bp, Zea mays
  misc_feature: Incyte ID No: 700381866H1
  unsure 32, 56, 84, 87, 117-118, 160, 196, 244: a, t, c, g, or other
ggcgacccagacaattataccctagccaaccncttaaacacccctccccacatcangcccgaatgatatttcctattcgcctanacnattctccgatccgtccctaacaaactaggnngcgtccttgccctattactatccatcctcatcctagcaatantccccatcctccatatatccaaacaacaaagcatantatttcgcccactaagccaatcactttattgactcctagccgcagacntcctcattctaacctgaatcggaggacaaccagtaagctacccttttaccatcattggacaagtagcatcg

SEQ ID NO: 7517 - DNA, 305 bp, Zea mays
  misc_feature: Incyte ID No: 700381870H1
gctgcaaatgaggctggagaagatggtgcttcggaggaaggtaaaggtacagatgtggagatgaaagatgctgaaaacgctgaagacgagaagaaagaggtcccaaatgcagatgctgcagagaagactgaggaaggtgaagataagaaagaggaggcccctgctgtagatgcagcagagaagactgagaaaggtgaagataagagagaggaggaggcccctgctgtagatgcagcagagaagactggtgagaaagaggtggcccctgctgtagatgcaacagaggagacagaaaaaagcaccga

SEQ ID NO: 7518 - DNA, 302 bp, Zea mays
  misc_feature: Incyte ID No: 700381871H1
  unsure 14, 25-27, 237: a, t, c, g, or other
cctctccccccgcngccgagctcannncggcgcctgccgcctgaacttgtctcgcccgcggcagatctgctccttccgctcgctgcaccgcaacccggataggagaccgcgcgcggtcgagaactacctggggaccaacgtcctcgaccagctccggtgcggccggcacacagctccacagatttggacagcgcaattacttaagctatttgtattcggatctgatccaaccctggnggtcagctggactcatcgcccatggagcacactaagtcaggccccagcagttggccagaatggcg

SEQ ID NO: 7519 - DNA, 298 bp, Zea mays
  misc_feature: Incyte ID No: 700381874H1
  unsure 29: a, t, c, g, or other
ccagatctggagaaatcgcgaagtcgtcntcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggccttgccatgatgggtgcgctcgcatggcaggccaggcaataataa

SEQ ID NO: 7520 - DNA, 301 bp, Zea mays
  misc_feature: Incyte ID No: 700381875H1
ctgacctaccgtgtgcccagcaccatccttgcgacaggggaagcagcagtgagcaaaacagaggcccttcctccaggacctccacactctgggagacaggaacctaagacccaggcctagaagaggaaacttgcagtgtgtagggggtgcccttgggatgggctgggatggagggtaaggatagagaggacagaggcagccccatgacttgagtctagtcattcgaggggccaggccctggggatgggaatccgttcctcctctctctccccttcctccttgggtgaatcaaccaccaccc

SEQ ID NO: 7521 - DNA, 301 bp, Zea mays
  misc_feature: Incyte ID No: 700381876H1
  unsure 242: a, t, c, g, or other
tcctttcctaggcctcgactcctcccgacgtgatcgctccagagaaaatttcgcgggtttagacaaacagcgattgggatcgagatcggggcaacatgagcaaggtgttcgagggctacgagcgccagtactgcgaggcgtccgcctccctcacccgcaaatgcaccgccgccgccgccctacagggagagaagctgaagcagaaggcggcggagatccaatccggcatcgatggcgctgangcactgataaggaagatggatcttgaagcaagaaacctgcaaccaagcattagagtgat

SEQ ID NO: 7522 - DNA, 303 bp, Zea mays
  misc_feature: Incyte ID No: 700381878H1
  unsure 82, 145, 147, 179-180, 186, 196, 221, 233: a, t, c, g, or other
cgaatcagaacccgaccatctcgtttacgatttcctcaacctcgtgaccgctcaggttctccctgtcgtggaggccagggcngcgatgggcgcggtcgtggacgtggacgtgagggactctgcgatgttccattcccttctcgcngngggaaatttgctgccgcccttcctcacgctgnnacagcnacacgacgangcagatacgaacttcggttccagcnaggacaaggagntgctcgaccttctcgaaggtatgctggccaccgaatccgtggtggtgaagagagaccagcgcatcgtgcc

SEQ ID NO: 7523 - DNA, 309 bp, Zea mays
  misc_feature: Incyte ID No: 700381879H1
tgggaaggttcctgttctggagactcctgatggccctgtttttgagagtaatgctatcgcacgctatgttgctcgcttgaaggatgacaaccctctttttgggtcttcccgtattgaacaagcccacgttgagcaatggatggattttgccgcaacagaagttgatcctggtgttgcatggtacttgtatccaaggcttgggtacctcccttatgttagcacaactgaggaaacagctatttcttcattgaagaggtcgcttggtgctctgaacacacaccttgcttcaaacacataccttgttgggca

SEQ ID NO: 7524 - DNA, 307 bp, Zea mays
  misc_feature: Incyte ID No: 700381880H1
cccacgaggaattcccaacaatcttatgccctatgttcagcaagttgcggttggtaggaggccagctctaacagttttaggaaatgactatgcaacaagagatgggactggggtccgagattacatccatgtggttgaccttgctgacggacatattgctgcattgcagaagctttttgagaactctagcatagggtgtgaagcgtacaaccttggaaccggaagaggtacatctgtgctggagattgttaaagcatttgagaaggcttctgggaagaaaatacctctgatttttggtgaaagacgc

SEQ ID NO: 7525 - DNA, 300 bp, Zea mays
  misc_feature: Incyte ID No: 700381882H1
  unsure 4, 9, 56, 65, 78, 82-83, 124, 147, 150, 163-164, 168, 183, 194, 213, 270,: a, t, c, g, or other
cgtncagcncctgtggagatctcctatgagaacatgcgttttctgataactcacanccctaccantgctactctcaanaagnntcacagaggaacttaagaagtatggagtgacgactttggtncgagtttgtgatgctacatatgntanagctccagttgannaagnaggaatccacgttcnagattggccanttgatgatggagctccacnccctaatcagatagtagatgattggttaaacctgttaaaaacccaatttcgtgaaananccagttgtgtgatncaggnaatgtgtgc

SEQ ID NO: 7526 - DNA, 296 bp, Zea mays
  misc_feature: Incyte ID No: 700381884H1
  unsure 64, 190: a, t, c, g, or other
tatttttataatatttgttttaaggcaaaacctagattgaattaaatgacagtttattacagcncctttggcagggctccagtttctctgaaaacaatttcgactctcgctctttggcttctctaaaggagccggagttgttttataattcgtttgaaaaaacagtttttcttatgtttatttcgaatgntctattagggaaacgaaggaggagccgttagaagccacgtttttggtgctctggctcccaacacaaaaatagctcaacctcttcgaggtctctcaacgaaaagccg

SEQ ID NO: 7527 - DNA, 294 bp, Zea mays
  misc_feature: Incyte ID No: 700381885H1
gctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggat

SEQ ID NO: 7528 - DNA, 227 bp, Zea mays
  misc_feature: Incyte ID No: 700381886H1
tctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgctttcgatgccgggtccaagaagaagttgctcatctttgactccgaggaggatctctcggtttctc

SEQ ID NO: 7529 - DNA, 294 bp, Zea mays
  misc_feature: Incyte ID No: 700381887H1
gcctccgacatcctactttcgtcctcacgagtgaccgataatccgccggcgctaagatgttggtttatcaagatctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggacgaaagcgttgatgacacagccgtgaaggtggttgatattgttgacacattccgtctacaggagcaacctc

SEQ ID NO: 7530 - DNA, 192 bp, Zea mays
  misc_feature: Incyte ID No: 700381888H1
  unsure 62: a, t, c, g, or other
attgtagagaatttccttcctactgagaatctacctctattccccctgccctagctcttctntaacttggttaaccataaccataaccagattcccttgcaatcgatttctctttagtcgttggtgttagaagtaccagcacaatttgagcattcccattaacaaaggtgttcacagttgagaaactctcct

SEQ ID NO: 7531 - DNA, 293 bp, Zea mays
  misc_feature: Incyte ID No: 700381889H1
  unsure 31, 102: a, t, c, g, or other
aaaccctagcacacgcaccatggcggcgcanagaagatccggtggggggagctggaggaggacgatggcggggacctcgatttcctcctcccgccccgcgtngtcgtcggacccgacgagaacggcctcaagaaggtcatcgagtaccgcttcgacgacgacggcaacaaggtccgggtcacgaccaccacccgcgtccgcaaactcgctcgggcgcgcctctcccgcagcgccatcgagcgccgccagtggcctaagtttggggacgccctcaaggaggacgccggctccag

SEQ ID NO: 7532 - DNA, 266 bp, Zea mays
  misc_feature: Incyte ID No: 700381890H1
  unsure 36, 82, 212: a, t, c, g, or other
tggtggtgttcgggtatgaggctgggactaagccangggattcaggtgtggtgccggtgggaactgaggaagcgcccaaggnaatgaaacacgatttccaaaatgaacttaatctttcatgagaaactgaggatagagatgtcaataagcagccactgtttccacctccccacctgaagagctaggaggacaactacaaagagcctgactgncttctcggaatgaggagagaggaaaacagcaacagtatcagttttcaagatggc

SEQ ID NO: 7533 - DNA, 295 bp, Zea mays
  misc_feature: Incyte ID No: 700381892H1
aaacaaatcaacaatgagaaaaacaaccccattaaaaactgggcaaaggccatgaatagacctttctcaaaagaatacatacatgtggcaataagcatatgaaaaaaatggttaatatcgctaatcattaaggaaatgcaatcaaagccacaatgagataccatctcagacctgtctgaatgggtattatcagaatgggtattattaaaaaatcaaaacatagatgctagtgaggctgcagagaaaagcaaatacttatacactgctggtgggaatgtaaattaattcagccatt

SEQ ID NO: 7534 - DNA, 301 bp, Zea mays
  misc_feature: Incyte ID No: 700381896H1
  unsure 3, 86, 228, 253, 261, 271-272: a, t, c, g, or other
gtnctccccgtctccgcccgcactcgctcgtccgcgcgcaggaaggttgacctgtcgggggccggcgagcccggtaagtaagagtnaaaatggatggaagtagtaaagggagtgggcattctgaagcattaaggaactacaacctgggaagaactttaggtatcggtacatttggaaaagtgaagattgcagagcataagcttactggacatagggttgctataaagntcatcaactgccgccaaatgagganatatgganatggaagagnnagcaaagagagaattcaagatattgaagt

SEQ ID NO: 7535 - DNA, 306 bp, Zea mays
  misc_feature: Incyte ID No: 700381902H1
  unsure 68-69: a, t, c, g, or other
ggaatcacgcctcgaagatggctccggttttgtaaccctgagttgagtgaaatagtcacaaaatggcnnaagtcagatcagtggacaagtaatcttgatctgctcactggacttcgcaaatttgcagatgatgaaaagcttcatgctgagtgggcagcagccaagttatcttgcaagaagcgcctggccaaacatgtgttggatgtgacaggtgttacgattgatccaactagcctttcgatatacagattaagcgcatacatgagtacaagagacagctcctaaacatattgggagctgtttaca

SEQ ID NO: 7536 - DNA, 306 bp, Zea mays
  misc_feature: Incyte ID No: 700381903H1
  unsure 232, 234-235: a, t, c, g, or other
gtctagctgttggctttggcctgaactggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttctngnngtgatacctattacggatgagttctggaaaagacccagctatgattcataaaaacacttctggatgaaaaa

SEQ ID NO: 7537 - DNA, 304 bp, Zea mays
  misc_feature: Incyte ID No: 700381904H1
  unsure 9, 129: a, t, c, g, or other
cttaaatantttattttagatttggggtatatgtgcaggtttgttacatgtgcatacattttcagtgctcttgtatttacattttaatctggatgttatatctcactttacagaatttttttcacagtnatttctctctagggtttgtggtggaacacatgtagacagagaaatagttgttaggaagacatagacctggtagtttgtcactctgaagtgggctgtcagctgaaaagcttgaagaccatgggtctagacagacagctcattccaactacaactatcatagattgaccaactcctg

SEQ ID NO: 7538 - DNA, 168 bp, Zea mays
  misc_feature: Incyte ID No: 700381907H1
  unsure 5-6, 17, 20, 40, 59, 106, 114, 116, 119, 127, 129, 135, 139, 142, 147, 152,: a, t, c, g, or other
gtcannacgagggaagnttnttccactacagtccttgagncccgcccatcaacgactanacgctggtacaagctgcaccaaccctagccccataaccctaggtccntcctccangnccncttccagngnggcgangaangangcganagganccatnganncctccgg

SEQ ID NO: 7539 - DNA, 303 bp, Zea mays
  misc_feature: Incyte ID No: 700381912H1
  unsure 53, 55, 66, 74, 121, 138-139, 146, 163, 173, 179, 185-186, 200, 205, 214,: a, t, c, g, or other
tgaaagtagaaatttgactgaagctcctacttccttatacagcctttccttcngngggcttgtcanttttcagnacatttctagtggggaagagcagggcgacccctctgctgggtttctncttaaatgtgaagcaanntaaattnatataatggaatttggnggcagtgacngatgtnggtacnntagctaaaaccaantgttnagttgactncttagttataggaccagttggaagtcctgttnactggnntnnattatgctggtgttaanacactagagtaantagaattngggattcta

SEQ ID NO: 7540 - DNA, 303 bp, Zea mays
  misc_feature: Incyte ID No: 700381913H1
  unsure 142-160, 186, 196, 223, 229, 233, 241, 247, 266-267, 284, 286: a, t, c, g, or other
tgtccccatagtgggccccttgacccacatgctgaccggtgccttgggatttgactagagttgctggcttcgaggcccagcacgaggacttaccctggggttttgttaggtttggaagcagctgtccctagggggtgaagtnnnnnnnnnnnnnnnnnnnacccctgcttttcccaggggttaacntccctatgtnaactgtagactcagatcccaataaagngctgtngcanctatgatnctaggnggtttctaagcacaggggnnaccccaaaccccctgcntnaatggatgggtcatccc

SEQ ID NO: 7541 - DNA, 303 bp, Zea mays
  misc_feature: Incyte ID No: 700381914H1
cagatcttgtcttcataacagctgggatgggagggggtactggatctggtgctgctccagttgttgcccagatatcaaaggaagctggttatcttactgttggtgttgtcacctatccattcagtttcgagggccgtaagcgctctgtacaggcattggaagcactagagaagctggaaaagagtgtagacacacttattgtgattccaaatgataagttattagatgttgcggatgaaaacatgcccttgcaagatgcatttctcctgcagatgatgtccttcgtcagggtgttcaaggaat

SEQ ID NO: 7542 - DNA, 136 bp, Zea mays
  misc_feature: Incyte ID No: 700381915H1
  unsure 2, 9, 18, 25, 31, 35, 43, 48, 51, 76-77, 109, 117, 125, 133-134: a, t, c, g, or other
tnttcatancaccagggnttgctgnacgtgnatcngctgaggntaaanccnattcattttctcgcaccctgcggcnntcttgtttttagaataaacttttaaaaagganaaaaaaangttcagtnttgttatnnct

SEQ ID NO: 7543 - DNA, 299 bp, Zea mays
  misc_feature: Incyte ID No: 700381918H1
cccgtttctcccttctctgggctcggagaatcggagatggcgtccagcgcctctcggttcatcaagtgcgtcacggtcggcgacggtgccgtgggcaagacatgtatgctcatctgctacaccagcaacaagttccccactgattacatacccacggtgttcgacaatttcagtgcaaatgtcgttgtggatggcaccacggtgaatttgggcctgtgggataccgcaggcaggaagattacaaccgactgaggcctctaagctaccgtggtgcagatgttttcgtgcttgcattctca

SEQ ID NO: 7544 - DNA, 298 bp, Zea mays
  misc_feature: Incyte ID No: 700381919H1
gcaggtctgaagggtgctggcatgggcacaggagattactcaaacccgtttgatctctttgagtccctgtttgaagggtttggtggaatgggtggaatggggggtggccgtgctgctcggaacagaccaatgcaaggtgatgatgagagctacaatctggtactcaatttcaaggaagctgtgtttggtgtggagaaggagattgagataaccagattggaaggctgtaacacctgcgacggaagtggtgccaagccaggtacaaaggcaacgacatgtaaaactgtggaggtcaggg

SEQ ID NO: 7545 - DNA, 299 bp, Zea mays
  misc_feature: Incyte ID No: 700381920H1
ggtaaatgaagaagaggtgaccgttcttgaaaataattatggagtaaatggtaatggagtaccagccatctatccgatggatggacatgcagaaaatggtcacaaaactatggccaagggtctggatggtaaaaatggatttgtatctaagagtcttgagaaaagagcagtagctgctttgaacaaatttggtgagaacgcaaagatgatgtctgatcctatgtggatgcggaggccccaacctactcctgagccaactgtgatggttgccgagaagccaacattgacaagtatttggt

SEQ ID NO: 7546 - DNA, 296 bp, Zea mays
  misc_feature: Incyte ID No: 700381921H1
  unsure 135-158: a, t, c, g, or other
aacgacagagaagagagtccatctgctcgttgccttgattttgtggaacgaagcgatggctcgcagcggcgccatggtttcctgcatgctgctcctggtggtggcggcgcaactgctcatggtggtgatggccannnnnnnnnnnnnnnnnnnnnnnngcgaccaacgcggagagcacgccggctgctgtggcaggtgacctgccactacagcgcctgtaactgccgcacttgcccgacatatggctgggcgtgctgcagcacttgctgctagctagctagctagctagctagtgt

SEQ ID NO: 7547 - DNA, 297 bp, Zea mays
  misc_feature: Incyte ID No: 700381923H1
gaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaa

SEQ ID NO: 7548 - DNA, 281 bp, Zea mays
  misc_feature: Incyte ID No: 700381924H1
  unsure 87, 91-92: a, t, c, g, or other
agacagtgcagccacccagcctttaccagcagcgtacggcagacgaaggcagtccgaggtgtggaggtgatcacgaagatacatgtnctcnnactgtttaatttgatagtttacattttttatgctttgtgttggtgtgtaatttttgtactcttggtggctagtttttgtcaaatcttttttggaatattgcttaaatgttttgattttatgatagtgaagctgtattcagtgttttgccaattaatattatatgctgtaataaaagcaaaagaaaagct

SEQ ID NO: 7549 - DNA, 293 bp, Zea mays
  misc_feature: Incyte ID No: 700381925H1
  unsure 20, 37, 90-92, 95, 123: a, t, c, g, or other
atctatgagggctatgcctngccccatgccatcatgngtctggatctggctggccgagatctcactgactacctcatgaagatccgactnnnggngctattccttcgttactactgctgagcntgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttcc

SEQ ID NO: 7550 - DNA, 296 bp, Zea mays
  misc_feature: Incyte ID No: 700381926H1
catcaccaaatgggatccttttattccgagaggttagcaagataatcgtggcttacgggtcacgaattctattgcttcctaatggcacagacatttatggaagtaaatacaaaggcatatggatctcactgactgttctttcaagggctttgtgtgggaattatgtcaattttggcgtatttgagctctatggtgacagagcacttgctgatgcccttgatatatctctgaagatgaccctctcagttccattatctgatatattggcattcaaaaagctgtcgaaagcgtacttt

SEQ ID NO: 7551 - DNA, 301 bp, Zea mays
  misc_feature: Incyte ID No: 700381928H1
  unsure 122: a, t, c, g, or other
gggagagagagagggggaaggccaagaagaggcttcctctccccccattctccaatccgtgccctagttcgagccagccgcgaggaaggaggcgtctcgctagcgcccgcccgtcggccganccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctg

SEQ ID NO: 7552 - DNA, 298 bp, Zea mays
  misc_feature: Incyte ID No: 700381929H1
caggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtaccctcttgtctctctggcaatcttgcccttaatatccctggagttcctcatcag

SEQ ID NO: 7553 - DNA, 300 bp, Zea mays
  misc_feature: Incyte ID No: 700381930H1
gaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttc

SEQ ID NO: 7554 - DNA, 291 bp, Zea mays
  misc_feature: Incyte ID No: 700381931H1
  unsure 2, 24, 78, 83-84, 93, 132, 170, 176, 182, 184, 209, 214, 226, 258, 261,: a, t, c, g, or other
ancttttatagactttatatattnccttttgataaagggatgctgcatagtagagttggtgtaattaaactatctcanccggnnccctgcttncccttctgctcatatgcctcattgtccttccagggagcnctttaatcttaaagttctacatttcatgctctagtcanattcantcaccntntaataactcttcccactgcatattnccaantgaattggtggntcaaaattcgaaactgtagttgagatacagcnatntaanattctggganatgtgcaccctcgnct

SEQ ID NO: 7555 - DNA, 304 bp, Zea mays
  misc_feature: Incyte ID No: 700381932H1
  unsure 26-27, 121, 202: a, t, c, g, or other
cacagctcacagcaaacaccgcgaanncgcccccgctcccaaaccccgaccgagcaaagcgcaaagccccccaaccgcggatcaatccgcagcatcgatggcgcccaaggcggagaaaaanccggcggcgaagaagcccgcggaggaggagcccgcgaccgagaaggcggagaaggctccggcagggaagaagccgaagggnagaaacgcctccccgcgggcaagtccggcgccggcgagggcaagaagggcaagaagaaagccaagaagagcgtggagacttacaagatttaattttcaaggt

SEQ ID NO: 7556 - DNA, 298 bp, Zea mays
  misc_feature: Incyte ID No: 700381933H1
  unsure 124: a, t, c, g, or other
gggggaaagaggagggcagagcagcaacagtacatcgagcgagggagtagagcaaattgaatcaggtttcgtgtcgattcggaggctttcgcttctgcttgcggagttgcggtggagatttgangcctgcggcgaagatggcacctgcggaatccggggagaaggcgaccagcttcgccatggcctgcagcctgctcagccgctacgtcaggcagaacggtgccgccgctgccgatctcggcctcgctatcagagctgaatccgatgcaaagaggacgtcggcggacatggaaaaggg

SEQ ID NO: 7557 - DNA, 294 bp, Zea mays
  misc_feature: Incyte ID No: 700381934H1
  unsure 45: a, t, c, g, or other
caaaagatccatctgaaggcgttacagtgaaggaatttgatccanatacttgtacttggtcgattgtcaggacttatgggaaaccaccggtttctcgtggaggtcaaacagtgactcttgttggaacgacgctagttttgtttggtggtgaagatgcagaacggtgtctcttgaatgacttgcacatccttgatcttgaaaccatgacatgggatgatgtggatgcaataggcacccctccttctccaaggtcagaccatgctgctgcttgccatgctgaccgctatcttttaa

SEQ ID NO: 7558 - DNA, 293 bp, Zea mays
  misc_feature: Incyte ID No: 700381935H1
  unsure 6, 11, 21, 28-29, 40, 47, 49, 55, 61, 75, 84, 94, 108, 123, 130-131, 151,: a, t, c, g, or other
ggtganttganatctaggcgncatctgnntgttcgtgganagagtgnanccttgncatcantaactgacaaggantgggacganattaagtttngtgtggataatcangttgattactatgcngtttctnntgtgaaagatgctcaagttntccacgaactcanggattancnaanaantngcaatgctnacntacatgtnatcgtcagaatagaaagtgcagactccatccccaacttacattcaatcatcacagctnctgatgnggctatggtngccaggggtganctggg

SEQ ID NO: 7559 - DNA, 290 bp, Zea mays
  misc_feature: Incyte ID No: 700381937H1
  unsure 107: a, t, c, g, or other
cacagaagcggcggcggcggagaaacgcaggcgaaggcgagggtgtgagggaaggagcaccagccatggtgcacgtcaacttctaccgcaactatggtaagacgttncagaaaccaaggcgtccttatgagaaggagcgtcttgatgctgaactgaagctggtcggtgagtatgggctgaggtgcaagcgtgagtttggagggtccagtatgcactgagcaggatccgtaatgctgcaaggcacttgctcacccttgacgagaagaacccccgtcgtatctttgagggtg

SEQ ID NO: 7560 - DNA, 289 bp, Zea mays
  misc_feature: Incyte ID No: 700381940H1
catccacatccttgtccgcggcgaaacacaatttcccacagcgagcgaggttcccctcccgactcggtgatggcggcgccggcggcggacgaggcatggtgccgaaagacggtgccacgggtgatggaactggtgtgtcggcgccttccgcagcgggacgcatgcgcgctgcttgctgtcagtccctggtgctaccgtgccctcgttgctaactccaggctctgggaggtacttgatctacgtgagatgaagaatgctggaaaccgacttatttcagcactttcactgg

SEQ ID NO: 7561 - DNA, 290 bp, Zea mays
  misc_feature: Incyte ID No: 700381942H1
ggagcattgatgcagctgtccttgttcattcatatgataatgaaaggtctggtggacatcagaagacaagactatcagcaattaatgttcctcctatgggtcttctttacccaagggttcttgttccagaagagtaccctccacctcctcgatcttggttccaagactatgatgacatgctggaggatacctggcaaacaagtgatggtctttaccctagtgggaatggtgggtttggcatgtgggacagttatccgatgtttcccactagattaaagaaatttgataac

SEQ ID NO: 7562 - DNA, 294 bp, Zea mays
  misc_feature: Incyte ID No: 700381943H1
  unsure 18, 40, 60, 74, 162: a, t, c, g, or other
caaacccactccaccttnactaccagacaaccttagccancaccatttacccaaataaantataggcgataganattgaaacctggcgcaatagatatagtaccgcaagggaaagatgaaaaattataaccaagcataatatagcaaggactaacccctatnccttctgcataatgaattaactagaaataactttgcaaggagagccaaagctaagacccccgaaaccagacgagctacctaagaacagctaaaagagcaaacccgtctatgtgccaaattagtgggagattt

SEQ ID NO: 7563 - DNA, 293 bp, Zea mays
  misc_feature: Incyte ID No: 700381945H1
aagaagcagatctcgtgctctatgcagttgacaaaccgaacagatgactacatcggctttaaggttaagacgacgagcccgaagaagtactgtgtccggcccaacagcggcatcgtgccacctcggtccaccagcgatgtcattgtgacaatgcaagcacaaaaggaggcgccaccggacatgcagtgcaaggacaagtttcttgtgcaaagtgtcgttgtggcggaagggaccttagtcaaggacatcactggcgatatgtttaccaaagaatcagctaatgtggtggatga

SEQ ID NO: 7564 - DNA, 276 bp, Zea mays
  misc_feature: Incyte ID No: 700381946H1
  unsure 2: a, t, c, g, or other
cncggcgcccctctcccactccccagcagccgccagcccgcacacccctccctcgcgcgctcagggtttcggaatggaagccgaggcggcggccaagaggacgcgggacagcggggaggacgccgccgcggcggggatctccgccgtcatcccgggaacgttctccgagatcagccccatgtggcccggtgaggcgcactctttgaaggtggacaaggtgctgttccaagggaagtcagactaccaaagcgttatggtctttcagtcctctacgta

SEQ ID NO: 7565 - DNA, 295 bp, Zea mays
  misc_feature: Incyte ID No: 700381947H1
ccagagcagtgcaaggctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagccagagagtgcagtgcgcgcaacagtaagcagactatcatcaaggcaattgggaggggtggtgccttaaagcatgggagtgatctctggttttgctgtcgccgag

SEQ ID NO: 7566 - DNA, 297 bp, Zea mays
  misc_feature: Incyte ID No: 700381948H1
  unsure 31, 73: a, t, c, g, or other
cagatagctctgaattaaatgatagaaagantgatatggataatagcgacgtggattcaaggccaagaaaganaagggcagaaaaggctaaagtcaccaaaaaacagaaaatagttacaaatgagaggaaactgtcaactccaaaggctaaaaaggttgcaaaacaagatttgggtagcagtactgaagaacagggtggcaattcagcagaagaggatattctcattcatccgctgaggaagataataagagaaaacggcaacagactccagcttatgggaaacaagcagagcatct

SEQ ID NO: 7567 - DNA, 318 bp, Zea mays
  misc_feature: Incyte ID No: 700381949H1
  unsure 101, 104, 234, 255, 258, 268, 280, 285-286, 289, 297, 314: a, t, c, g, or other
ccaaacaccctagctaatagttcagctattagctatttttagtaaattagttaatagttaggtagctatttgttagctagctaattccactaacaattttnagncaactaactattagttctaatacattcaaacacccctttagactcacgtaccaagtcaataactgcttctaacgtagggaggtgttctgtctagtaactaatgtacactgatctaccggtgactgttagngtatcggttctcaaggttttnctnccaaggtatnccatggaaaacntcccnnaanggtgggcncccctttgggggaaaanattc

SEQ ID NO: 7568 - DNA, 286 bp, Zea mays
  misc_feature: Incyte ID No: 700381950H1
gagaagcagaggttctttggcaagctcaaggcgtaaggtgctgcggtgcagcgacaagtcccatttctcaaaatcatcaaactgtgatacttttgtttgtaaccttgctgtactaagttttgtagccggatggtttgggagcatggtccggtcttctatggattgttccatgcttctgaactgcaatgtctatgttttgtgctactttggttgtttaatgccctaatcattgcatatagattccaatgttttggtgtttgatgatcaacataactatttatactaa

SEQ ID NO: 7569 - DNA, 316 bp, Zea mays
  misc_feature: Incyte ID No: 700381953H1
  unsure 243: a, t, c, g, or other
gccttagctatgctactgctgccgcggttgacatcgattggtcggctgagcccgggcccgcgcggacagggatcatctactggtgcccgcgccaggcttctccctgcagagcatgctgccattgccatcgacgtcgtcgtcgtttctagcacgaggctaccggcggcgtcggcgactgtctcgatgacgacggacgaccacggcaggtcactgtcaccagcagcggcgccgttgcgcgcgganagttggcgcggacctgtcctgggagcccgtgagcacgttgacctgcccaatcttgacgtaggagtagacgaat

SEQ ID NO: 7570 - DNA, 301 bp, Zea mays
  misc_feature: Incyte ID No: 700381954H1
  unsure 5, 10, 24, 34, 39-40, 43, 64-66, 102, 111, 116, 141, 144, 158, 161, 167,: a, t, c, g, or other
aaganttctncttgttaggcaagncaaaagcagnagcannaanagaaaggtcttgttgccgatnnnggagctcagggttctcgtggactcttccggaccacnccaagctcnccaangggaaaccggtggctgtcgtcgtgntgnacggatggggcgangcnaacccngaccagtacaactgcatccatgttcgccaaaantccgncatggganccataaaaaatggcgctcnngagnaatnngngntaattnaaggntnntggaccactngtnggcctccaantgntgatgacatgggcaa

SEQ ID NO: 7571 - DNA, 318 bp, Zea mays
  misc_feature: Incyte ID No: 700381957H1
  unsure 7-8, 13, 46, 52, 94-95, 101-102, 147, 186, 226, 231, 239, 247, 254, 257,: a, t, c, g, or other
cgacgannaccgnactgtgtgccgggagatccgccacaactccacnggctgnctagcgtgatgaaggaccagtgtgacaagtgccgggagatcnngtctgnngactgttccaccaacaacccctcccaggctaagctgcggcgggantcgacgaatccctccaagtcgtgagaggttgaccagganatacaacgagctgctaaagtcctaccagtggaagatgctnaacanctcctccntgctggancagctgnacnagcagtttaactgggngtcccggctggcaaacctcacgcaaggggangacnagtactatct

SEQ ID NO: 7572 - DNA, 318 bp, Zea mays
  misc_feature: Incyte ID No: 700381959H1
  unsure 2, 15, 29, 73-94, 179, 181, 255: a, t, c, g, or other
gnccgccgagcgggngcgcacatgcggancctctccctcgacgccgccttcttcgacggcctctcgctgcagnnnnnnnnnnnnnnnnnnnnnntaagagggggcgtggcggggcacaagaggagcggctccatggacggggacacctcgccgttcgagggcgagtcggcgccgccgtncngtgctgccggactacgccaagaaggccgtgcccgacgacaagctcgccgagctcgcgctcctcgatcccaagcncgccaagaggatctggcgaaccggcagtccgcggcgagtccaaggagaggaagatcaagtaca

SEQ ID NO: 7573 - DNA, 311 bp, Zea mays
  misc_feature: Incyte ID No: 700381960H1
  unsure 18, 30, 33-34, 40, 43-44, 67, 88, 128, 193, 237, 246, 256, 261, 265, 272,: a, t, c, g, or other
ctggggggacaagttttnttcactgagatngcnncacatngcnnttggcatttatgagattattcantttagaaagtatatataaccnggctcctctgaaatgcagaccagtttagctagggcggaanaatacagaccctgtttattggcagtaaacaagcatttatagcttgttatatataaggctcatcanatgcagctttggggaatatgtagatattgttcctccctcaaganctgtattantgaatgttgnacctnaccngggatanaaggtgcaggtgtagngncaggactaaaanccaatnatg

SEQ ID NO: 7574 - DNA, 199 bp, Zea mays
  misc_feature: Incyte ID No: 700381962H1
  unsure 57, 122: a, t, c, g, or other
acgcaattcccgtcttcccacgccgtatcgccgttgctatgggcaagaagcggaagnccgagcccaaatcggcggcagggttcacgccggttaaggcctccccgaccaccaggtctgccacngctagagccgctggtctatccgaggtcctcgcccccgtcgaggctacgatggagaagctgccgcagggggcaggcgg

SEQ ID NO: 7575 - DNA, 316 bp, Zea mays
  misc_feature: Incyte ID No: 700381963H1
  unsure 31: a, t, c, g, or other
caaccccagtttctctcatcaaatgcctganatccatcaagaaacacgcctttgttgcatctccctatcctgtcatcataacacttgaagaccacctcccctctcaactccaggagaaagttgccaagatggttgttgaagtatttggcaacatactgtactacccgccagacgacacccatgagctcaaagaattaccatcacctgaacaactcaaaggacgtgtcctcctctcaacaaagccccccaaggagtacctcgaaaccaagcttagtgatccacgaaggagggtgatgctgacctccatcttggcaaa

SEQ ID NO: 7576 - DNA, 83 bp, Zea mays
  misc_feature: Incyte ID No: 700381964H1
atttagtggtttttagtatgtttacagagtcatgcaaccatcaccacagtatcattgcaggatgtttttatcatccctcaaag

SEQ ID NO: 7577 - DNA, 315 bp, Zea mays
  misc_feature: Incyte ID No: 700381965H1
agcagccgagcgactaagcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtccggatccctactaaggttctccacatcaccactcgcaagtccccttgcggtgaaggaacaaacacatgggatcggtttga

SEQ ID NO: 7578 - DNA, 312 bp, Zea mays
  misc_feature: Incyte ID No: 700381967H1
  unsure 2-3, 8, 29-30, 32-33, 35, 39, 44, 47, 107, 133, 138, 232, 302: a, t, c, g, or other
cnnacaanatggcggataaggagaagaannannangggnagcanctnggacttgtccaagttacatcgacaagacgatccgggtaaagttccagggaggccgcgaancagtggaatcctgaagggcttcgacncactncctcaaccttgtgctggacgggcaccattgagtacatgcgagaccctgacgaccagtacaagctcacggaggacacccggcagctgggcctcgnggtgtgccggggcagtcccgtggtgctaatctgcccgcagacggcatggaggccatcccaacccttcatncagcagcagg

SEQ ID NO: 7579 - DNA, 310 bp, Zea mays
  misc_feature: Incyte ID No: 700381968H1
  unsure 127: a, t, c, g, or other
gcatgcaggagcttctgaaatcatggaaagattttgaagcaactcaggaggctacaaatgttgaaagtttacaaaacggtcctactcttgaaattcggatacctgccgaatttgtcacctccactantcgtcaagtaaagggtgctcaactttggggaacagatatatatacaaatgattcagatcttgtggctgtgctaatgcatactggctattgctcgcctacgtcctcccctcccccatctgccatccaagagcttcatgcaactgttcaagttctaccaccacaagagagttatacttcaacatt

SEQ ID NO: 7580 - DNA, 84 bp, Zea mays
  misc_feature: Incyte ID No: 700381969H1
  unsure 20, 31, 44, 55, 82: a, t, c, g, or other
tcgacagccagtaccacttntcttgccagtncacagctgacctnattgccatganccacaccgatttcatcatcaccagcanat

SEQ ID NO: 7581 - DNA, 225 bp, Zea mays
  misc_feature: Incyte ID No: 700381970H1
  unsure 10, 100, 127, 142, 151, 154, 176, 180, 185: a, t, c, g, or other
ctcgctcgcnggcaccgtcgccgtcccgcgcttcgtccaggcgtaccgtctcgattgcaccgccgcgctcaaccgcctcctccagtcgggcgtcccggcnaccgtcgagctccgcgccacgtccgcntcatccgcgccggcngccacctcngcntccgccgcagccatcgtgcacngggncaganttcatcacggcatgacgcgtcaagtcaacatgttgcaacg

SEQ ID NO: 7582 - DNA, 306 bp, Zea mays
  misc_feature: Incyte ID No: 700381971H1
  unsure 163, 281, 304: a, t, c, g, or other
atcttccccatcgatcccaacttccagtcgatctcctcgctcggctgttgcctcccaaagccgtgccttacaacgagattcctcccctcctctctccaataaccctagcctcctccgccgccggcgacgaatccggcgttttgagtttctgttgccagcgtancatgtccatgttcaataggatcttcgggaagcccaaggagcaggccaactccaatgccttgggcaatctggacaagttaaatgagactctgatatgctggagaagaaaggaaaagtgnggagaaaaagcaagcgtgaactnag

SEQ ID NO: 7583 - DNA, 311 bp, Zea mays
  misc_feature: Incyte ID No: 700381972H1
ccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcatccatagccatgtgcttgtccctgtgctcccacggttcccaggggccaggctggga

SEQ ID NO: 7584 - DNA, 309 bp, Zea mays
  misc_feature: Incyte ID No: 700381973H1
gcgacgactgacaaggcgaggggagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttgg

SEQ ID NO: 7585 - DNA, 309 bp, Zea mays
  misc_feature: Incyte ID No: 700381974H1
tttcatacacaaaggctgtggagctcttgaaaaatgttaccgacaagaagtttgacaacaaagttgaatggggaattgatttagcctctgagcatgaaaggtatttaacagaggatatatttaagaagccagttattgtctataactatccgaaaggaataaaggcattttatatgagactcaatgatgatgacaagacggtggctgcaatggatgttcttgtgcctaaggttggtgaattgattggtggaagccaaagggaggaacggttagatgttctgaaacagaggatacttgatgctggcctgc

SEQ ID NO: 7586 - DNA, 223 bp, Zea mays
  misc_feature: Incyte ID No: 700381976H1
  unsure 8, 32, 45, 55, 65, 81, 84, 86, 89, 114, 128: a, t, c, g, or other
gcagatcngaggacatctctgtgcaaggccanaaaaacgcccacntgcagttccntctccggganggacgtggggcccagnctncntgngccaccttgggctgaagctgctgcngctcctgctgctgntgcccctcaggggccaagccaacacaggctgctacgggatcccagggatgcccggcctgcctggggcaccagggaaggatgggtacgacggactg

SEQ ID NO: 7587 - DNA, 308 bp, Zea mays
  misc_feature: Incyte ID No: 700381977H1
atttgctacaccaccacacccacaccccatcccagcacacaacaagcagcctggtttacggtagctgctagcaaaacaatggagaaccctgctccgagcatcgtagtggccatcgccgcacccgtggcggcggagttcgtgaagctcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacagggagt

SEQ ID NO: 7588 - DNA, 204 bp, Zea mays
  misc_feature: Incyte ID No: 700381978H1
gtcggtgacgcatgtcgactggtccgaagggaagtggcatcccaaagtctacagggctgcggacacaagcttcgatctgctcaaggacatcgcgcatgtcgcgcagaggaggccgtgcgtgtggaacggcatgaagcggccctgctacctgttcgcgcgcaagttctacccagaggcgctggacaacctgctgaacatattctc

SEQ ID NO: 7589 - DNA, 308 bp, Zea mays
  misc_feature: Incyte ID No: 700381979H1
  unsure 132: a, t, c, g, or other
tcccagccgtgtgctggcagatagggttgtattatttcttcttaccccatgcctgaccaagggaggtcaaaaggagaaaagtataggctgtggacaataactgatgaatatagggcccagatggaccaagtngggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgcca

SEQ ID NO: 7590 - DNA, 305 bp, Zea mays
  misc_feature: Incyte ID No: 700381981H1
tctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctt

SEQ ID NO: 7591 - DNA, 153 bp, Zea mays
  misc_feature: Incyte ID No: 700381982H1
cgaactcgagacctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgt

SEQ ID NO: 7592 - DNA, 304 bp, Zea mays
  misc_feature: Incyte ID No: 700381983H1
  unsure 36, 62, 64: a, t, c, g, or other
gattattgacttcaccacaccccttgcctggcctgnccctgaggctcagcagtgcatgactncncagagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccat

SEQ ID NO: 7593 - DNA, 303 bp, Zea mays
  misc_feature: Incyte ID No: 700381984H1
  unsure 250, 255: a, t, c, g, or other
gtcgcgcggcgggcctaccagcgtcgtcatctacgacatccacgcgctccaggagaggttctacttcggggacgacgtcctgccatgcttcgagacagggatcccgctcctgctgcagcgcctccgccagctcccggacgcagaaaatatcaccattgcctttcccagatgacggtgcgtggaagcggttccacaagctgttacagcactttccaatgatagtctgtaacaaggttcgggaaggtgacangagantagttcgtataaaggaaggactacctgaaggccgtcatgttgttattg

SEQ ID NO: 7594 - DNA, 204 bp, Zea mays
  misc_feature: Incyte ID No: 700381985H1
  unsure 3, 7, 15, 23, 35, 42, 51, 63, 81, 83, 163, 196, 203: a, t, c, g, or other
ganctcncccgtctncgtcctcntccgcctctgtnagggtcncggtcgganttcctcacgacngccgcgccaaatcccgtntngttcctccgttccgctgcgcatcctacaggaatggaacttggcgccagtactgccctgtaccctctgcaccgctgcaaanaccatttaacttggtcaggaatgcccaaggggnattcacna

SEQ ID NO: 7595 - DNA, 302 bp, Zea mays
  misc_feature: Incyte ID No: 700381987H1
  unsure 14, 289: a, t, c, g, or other
gcttcattaaccanagctatcgaaattaagatgagtgacctcattggcctggagttcaagccagagaaacttcgcaagtaccatgagcacgtgattagcagcctctttgacgacgaccaaagccatcagtgtaaaacatgtggcaataggttcaggcttgaagaactgagcttgcacacatcaagctgtgggcaaaggaagtctgagactatatatactggtatcgcacctaaaagatggtaccctagcaagaacatttacttgatggatcacatggaattgaggacancactgaggcttct

SEQ ID NO: 7596 - DNA, 303 bp, Zea mays
  misc_feature: Incyte ID No: 700381988H1
  unsure 109: a, t, c, g, or other
ctcgaacccgagaggaaccctaacaccaaaacgcccccggaggcagctaggagagctcgaatcaccagccatgtcggagcacgacctcacggcgctgatggcggcgcantgggaccgccacctggtgttccccctgctggagttcctccaggagcggcagtctactcggagtcggagatcctggaggccaagatccgcctcctcagcggcaccaacatggtcgactacgccatggacatccacaagtccctctacggcaccgacgacgtgcccgaggacatggtgaagcgccgcgccgaggtc

SEQ ID NO: 7597 - DNA, 299 bp, Zea mays
  misc_feature: Incyte ID No: 700381989H1
  unsure 26, 60: a, t, c, g, or other
cccacacagaagcggcggcggcgganaaacgcaggcgaaggcgagggtgtgagggaaggngcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgactttggagggtccagtatgcactgagcaggatccgtaatgctgcaaggcacttgctcacccttgacgagaagaacccccgtcgtatctttgagggtgaggcg

SEQ ID NO: 7598 - DNA, 222 bp, Zea mays
  misc_feature: Incyte ID No: 700381990H1
  unsure 5, 10, 14, 30, 35, 41, 88, 95, 117, 123, 125, 127, 132, 135, 148, 157,: a, t, c, g, or other
gccantcttngggnccgcttctaccggcanatcanaagacntccggggatcatcccgatgatcggcttaatctgcctgggttgggcancgctgcngctttacttgctgcgactcgcncttcgnancnccgangtntgctgggacaganagaacaacncgganncctggaancgnctganccncaatgaccagtanaagttcctngcagtttccactgactat

SEQ ID NO: 7599 - DNA, 298 bp, Zea mays
  misc_feature: Incyte ID No: 700381993H1
  unsure 10: a, t, c, g, or other
cccgatcggncacggcggagaacgcgagtacccaggctctaataatttgtacaaaaccgatggaaacttctaaatctcctcaatcgtcaaagaacagtcatattgtggtgccttctgatagtaatggcccccgatttgacaatgatggtttttcttcagaagctgcatcaaatcaaatggtcgttttcaactctgaagcaggagataaagagcaagatgaactgggggaaaaccgtttgcagaagtcaatcataacaaggggaatatcgccatctattggagcatcactgtccaatgt

SEQ ID NO: 7600 - DNA, 283 bp, Zea mays
  misc_feature: Incyte ID No: 700381994H1
  unsure 141: a, t, c, g, or other
tggctatggagtacaggagggtgaaggatcaggagatttatgatgatttatctcagaaggatgtggaaagcctgagtgggaggacactatctagtgccaatactacagctattggtcccgcttctgcaggaggcgcaaaanccaactctagttggaagctaaagtctgttgttactcttgcattgacattgctaacaagttctcaggcaatattaattgtgtggtcaaaaagagctggaaaatatgaatatagtgtcacaacagctaatttttcggtggaggc
